United States Patent 10,138,444 (BACTERIA AND ENZYMES PRODUCED THEREFROM AND METHODS OF USING SAME) - sequence listing, part 2

SEQ ID NO: 1 - DNA, 4215304 bp, Bacillus subtilis (residues 1,405,103-2,810,204 of 4,215,304)
  modified_base (92206)..(92221): a, c, t, g, unknown or other
  modified_base (97963)..(98077): a, c, t, g, unknown or other
  modified_base (161668)..(161668): a, c, t, g, unknown or other
  modified_base (163248)..(163248): a, c, t, g, unknown or other
  modified_base (164867)..(164902): a, c, t, g, unknown or other
  modified_base (165555)..(165555): a, c, t, g, unknown or other
  modified_base (166792)..(166850): a, c, t, g, unknown or other
  modified_base (169385)..(169388): a, c, t, g, unknown or other
  modified_base (169844)..(169871): a, c, t, g, unknown or other
  modified_base (169967)..(170068): a, c, t, g, unknown or other
  modified_base (176583)..(176757): a, c, t, g, unknown or other
  modified_base (213087)..(222931): a, c, t, g, unknown or other
  modified_base (238257)..(241912): a, c, t, g, unknown or other
  modified_base (243779)..(243810): a, c, t, g, unknown or other
  modified_base (365852)..(365868): a, c, t, g, unknown or other
  modified_base (369250)..(369360): a, c, t, g, unknown or other
  modified_base (370126)..(370143): a, c, t, g, unknown or other
  modified_base (386201)..(386250): a, c, t, g, unknown or other
  modified_base (396473)..(396478): a, c, t, g, unknown or other
  modified_base (490531)..(490551): a, c, t, g, unknown or other
  modified_base (490575)..(490698): a, c, t, g, unknown or other
  modified_base (514754)..(514801): a, c, t, g, unknown or other
  modified_base (524279)..(525644): a, c, t, g, unknown or other
  modified_base (529533)..(549829): a, c, t, g, unknown or other
  modified_base (550104)..(551209): a, c, t, g, unknown or other
  modified_base (551244)..(556201): a, c, t, g, unknown or other
  modified_base (560780)..(560792): a, c, t, g, unknown or other
  modified_base (561459)..(561473): a, c, t, g, unknown or other
  modified_base (570109)..(570145): a, c, t, g, unknown or other
  modified_base (585089)..(585108): a, c, t, g, unknown or other
  modified_base (591905)..(593378): a, c, t, g, unknown or other
  modified_base (602793)..(602794): a, c, t, g, unknown or other
  modified_base (621595)..(621633): a, c, t, g, unknown or other
  modified_base (635497)..(635503): a, c, t, g, unknown or other
  modified_base (651867)..(663181): a, c, t, g, unknown or other
  modified_base (663330)..(663389): a, c, t, g, unknown or other
  modified_base (663564)..(663732): a, c, t, g, unknown or other
  modified_base (663917)..(664144): a, c, t, g, unknown or other
  modified_base (694261)..(694347): a, c, t, g, unknown or other
  modified_base (737336)..(737349): a, c, t, g, unknown or other
  modified_base (738952)..(746110): a, c, t, g, unknown or other
  modified_base (746561)..(748678): a, c, t, g, unknown or other
  modified_base (749652)..(749847): a, c, t, g, unknown or other
  modified_base (773989)..(774088): a, c, t, g, unknown or other
  modified_base (813833)..(814047): a, c, t, g, unknown or other
  modified_base (818883)..(822860): a, c, t, g, unknown or other
  modified_base (846232)..(846331): a, c, t, g, unknown or other
  modified_base (846389)..(846405): a, c, t, g, unknown or other
  modified_base (846459)..(848931): a, c, t, g, unknown or other
  modified_base (849066)..(849644): a, c, t, g, unknown or other
  modified_base (849721)..(849958): a, c, t, g, unknown or other
  modified_base (886720)..(886732): a, c, t, g, unknown or other
  modified_base (886908)..(887338): a, c, t, g, unknown or other
  modified_base (887723)..(887730): a, c, t, g, unknown or other
  modified_base (888387)..(888413): a, c, t, g, unknown or other
  modified_base (893756)..(893836): a, c, t, g, unknown or other
  modified_base (910650)..(910657): a, c, t, g, unknown or other
  modified_base (957592)..(959190): a, c, t, g, unknown or other
  modified_base (1124971)..(1125053): a, c, t, g, unknown or other
  modified_base (1159006)..(1159788): a, c, t, g, unknown or other
  modified_base (1160021)..(1160111): a, c, t, g, unknown or other
  modified_base (1160336)..(1160360): a, c, t, g, unknown or other
  modified_base (1213855)..(1214035): a, c, t, g, unknown or other
  modified_base (1214270)..(1214340): a, c, t, g, unknown or other
  modified_base (1214394)..(1214475): a, c, t, g, unknown or other
  modified_base (1214706)..(1215224): a, c, t, g, unknown or other
  modified_base (1215253)..(1215683): a, c, t, g, unknown or other
  modified_base (1216102)..(1216615): a, c, t, g, unknown or other
  modified_base (1250589)..(1251919): a, c, t, g, unknown or other
  modified_base (1262865)..(1264966): a, c, t, g, unknown or other
  modified_base (1265298)..(1267330): a, c, t, g, unknown or other
  modified_base (1267560)..(1267954): a, c, t, g, unknown or other
  modified_base (1268106)..(1268168): a, c, t, g, unknown or other
  modified_base (1268546)..(1269906): a, c, t, g, unknown or other
  modified_base (1270089)..(1270395): a, c, t, g, unknown or other
  modified_base (1278382)..(1278434): a, c, t, g, unknown or other
  modified_base (1289481)..(1289868): a, c, t, g, unknown or other
  modified_base (1334747)..(1335429): a, c, t, g, unknown or other
  modified_base (1335454)..(1336083): a, c, t, g, unknown or other
  modified_base (1336133)..(1336687): a, c, t, g, unknown or other
  modified_base (1336722)..(1337208): a, c, t, g, unknown or other
  modified_base (1338160)..(1338166): a, c, t, g, unknown or other
  modified_base (1338905)..(1338974): a, c, t, g, unknown or other
  modified_base (1344625)..(1344673): a, c, t, g, unknown or other
  modified_base (1344851)..(1345162): a, c, t, g, unknown or other
  modified_base (1353976)..(1354033): a, c, t, g, unknown or other
  modified_base (1441803)..(1441883): a, c, t, g, unknown or other
  modified_base (1443757)..(1445742): a, c, t, g, unknown or other
  modified_base (1445953)..(1446019): a, c, t, g, unknown or other
  modified_base (1478759)..(1482128): a, c, t, g, unknown or other
  modified_base (1539711)..(1539923): a, c, t, g, unknown or other
  modified_base (1780148)..(1780194): a, c, t, g, unknown or other
  modified_base (1782427)..(1859858): a, c, t, g, unknown or other
  modified_base (1879742)..(1879805): a, c, t, g, unknown or other
  modified_base (1882890)..(1882908): a, c, t, g, unknown or other
  modified_base (1883610)..(1884143): a, c, t, g, unknown or other
  modified_base (1886487)..(1886898): a, c, t, g, unknown or other
  modified_base (1909077)..(1910736): a, c, t, g, unknown or other
  modified_base (1945675)..(1945794): a, c, t, g, unknown or other
  modified_base (1946016)..(1946048): a, c, t, g, unknown or other
  modified_base (1967676)..(1967749): a, c, t, g, unknown or other
  modified_base (1968097)..(1968135): a, c, t, g, unknown or other
  modified_base (1968602)..(1968797): a, c, t, g, unknown or other
  modified_base (1969275)..(1978433): a, c, t, g, unknown or other
  modified_base (1978583)..(1978683): a, c, t, g, unknown or other
  modified_base (1979386)..(1979388): a, c, t, g, unknown or other
  modified_base (1979641)..(1979668): a, c, t, g, unknown or other
  modified_base (1979831)..(1979920): a, c, t, g, unknown or other
  modified_base (1980621)..(1980710): a, c, t, g, unknown or other
  modified_base (1981045)..(1993707): a, c, t, g, unknown or other
  modified_base (1995858)..(1995890): a, c, t, g, unknown or other
  modified_base (1996287)..(1996287): a, c, t, g, unknown or other
  modified_base (2027715)..(2028687): a, c, t, g, unknown or other
  modified_base (2037074)..(2038174): a, c, t, g, unknown or other
  modified_base (2039658)..(2040893): a, c, t, g, unknown or other
  modified_base (2049569)..(2049598): a, c, t, g, unknown or other
  modified_base (2050204)..(2050458): a, c, t, g, unknown or other
  modified_base (2050876)..(2050962): a, c, t, g, unknown or other
  modified_base (2056215)..(2057053): a, c, t, g, unknown or other
  modified_base (2057504)..(2057704): a, c, t, g, unknown or other
  modified_base (2057977)..(2061004): a, c, t, g, unknown or other
  modified_base (2061069)..(2061109): a, c, t, g, unknown or other
  modified_base (2061917)..(2061991): a, c, t, g, unknown or other
  modified_base (2062054)..(2062136): a, c, t, g, unknown or other
  modified_base (2062213)..(2063361): a, c, t, g, unknown or other
  modified_base (2064279)..(2064821): a, c, t, g, unknown or other
  modified_base (2065010)..(2069122): a, c, t, g, unknown or other
  modified_base (2069993)..(2071142): a, c, t, g, unknown or other
  modified_base (2075663)..(2078921): a, c, t, g, unknown or other
  modified_base (2151912)..(2161333): a, c, t, g, unknown or other
  modified_base (2161641)..(2191352): a, c, t, g, unknown or other
  modified_base (2191461)..(2191521): a, c, t, g, unknown or other
  modified_base (2191794)..(2193454): a, c, t, g, unknown or other
  modified_base (2193510)..(2194761): a, c, t, g, unknown or other
  modified_base (2194831)..(2194931): a, c, t, g, unknown or other
  modified_base (2195061)..(2211746): a, c, t, g, unknown or other
  modified_base (2213328)..(2214758): a, c, t, g, unknown or other
  modified_base (2215081)..(2221766): a, c, t, g, unknown or other
  modified_base (2221973)..(2246613): a, c, t, g, unknown or other
  modified_base (2246878)..(2246914): a, c, t, g, unknown or other
  modified_base (2247129)..(2247138): a, c, t, g, unknown or other
  modified_base (2247192)..(2247307): a, c, t, g, unknown or other
  modified_base (2247474)..(2247701): a, c, t, g, unknown or other
  modified_base (2247770)..(2255291): a, c, t, g, unknown or other
  modified_base (2255565)..(2264541): a, c, t, g, unknown or other
  modified_base (2264765)..(2270278): a, c, t, g, unknown or other
  modified_base (2270875)..(2270910): a, c, t, g, unknown or other
  modified_base (2271888)..(2271967): a, c, t, g, unknown or other
  modified_base (2272216)..(2272245): a, c, t, g, unknown or other
  modified_base (2272442)..(2273767): a, c, t, g, unknown or other
  modified_base (2275053)..(2275966): a, c, t, g, unknown or other
  modified_base (2276174)..(2276429): a, c, t, g, unknown or other
  modified_base (2277292)..(2277723): a, c, t, g, unknown or other
  modified_base (2277953)..(2280210): a, c, t, g, unknown or other
  modified_base (2280358)..(2286286): a, c, t, g, unknown or other
  modified_base (2296986)..(2297716): a, c, t, g, unknown or other
  modified_base (2433445)..(2434763): a, c, t, g, unknown or other
  modified_base (2466339)..(2466397): a, c, t, g, unknown or other
  modified_base (2587391)..(2588404): a, c, t, g, unknown or other
  modified_base (2663114)..(2664405): a, c, t, g, unknown or other
  modified_base (2667354)..(2667525): a, c, t, g, unknown or other
  modified_base (2701673)..(2701904): a, c, t, g, unknown or other
  modified_base (2702230)..(2715662): a, c, t, g, unknown or other
  modified_base (2725101)..(2726926): a, c, t, g, unknown or other
  modified_base (2732600)..(2732622): a, c, t, g, unknown or other
  modified_base (2743833)..(2747775): a, c, t, g, unknown or other
  modified_base (2897976)..(2897977): a, c, t, g, unknown or other
  modified_base (2898039)..(2898063): a, c, t, g, unknown or other
  modified_base (3116006)..(3116306): a, c, t, g, unknown or other
  modified_base (3116585)..(3116685): a, c, t, g, unknown or other
  modified_base (3173804)..(3173804): a, c, t, g, unknown or other
  modified_base (3177930)..(3177933): a, c, t, g, unknown or other
  modified_base (3254022)..(3254291): a, c, t, g, unknown or other
  modified_base (3254466)..(3256586): a, c, t, g, unknown or other
  modified_base (3267586)..(3267940): a, c, t, g, unknown or other
  modified_base (3268039)..(3268364): a, c, t, g, unknown or other
  modified_base (3268463)..(3268573): a, c, t, g, unknown or other
  modified_base (3436585)..(3436594): a, c, t, g, unknown or other
  modified_base (3463834)..(3467017): a, c, t, g, unknown or other
  modified_base (3467080)..(3467332): a, c, t, g, unknown or other
  modified_base (3495566)..(3495627): a, c, t, g, unknown or other
  modified_base (3499134)..(3499270): a, c, t, g, unknown or other
  modified_base (3542644)..(3545582): a, c, t, g, unknown or other
  modified_base (3581055)..(3581114): a, c, t, g, unknown or other
  modified_base (3581304)..(3581583): a, c, t, g, unknown or other
  modified_base (3581800)..(3581976): a, c, t, g, unknown or other
  modified_base (3582058)..(3582160): a, c, t, g, unknown or other
  modified_base (3609430)..(3609606): a, c, t, g, unknown or other
  modified_base (3632919)..(3632928): a, c, t, g, unknown or other
  modified_base (3635019)..(3635322): a, c, t, g, unknown or other
  modified_base (3647026)..(3648382): a, c, t, g, unknown or other
  modified_base (3651182)..(3651249): a, c, t, g, unknown or other
  modified_base (3651334)..(3651415): a, c, t, g, unknown or other
  modified_base (3651578)..(3652378): a, c, t, g, unknown or other
  modified_base (3652455)..(3653060): a, c, t, g, unknown or other
  modified_base (3653241)..(3654516): a, c, t, g, unknown or other
  modified_base (3654674)..(3654866): a, c, t, g, unknown or other
  modified_base (3655025)..(3655491): a, c, t, g, unknown or other
  modified_base (3655635)..(3656855): a, c, t, g, unknown or other
  modified_base (3656990)..(3657107): a, c, t, g, unknown or other
  modified_base (3657371)..(3659282): a, c, t, g, unknown or other
  modified_base (3659306)..(3660452): a, c, t, g, unknown or other
  modified_base (3660514)..(3663199): a, c, t, g, unknown or other
  modified_base (3663802)..(3664035): a, c, t, g, unknown or other
  modified_base (3664206)..(3664362): a, c, t, g, unknown or other
  modified_base (3664599)..(3664625): a, c, t, g, unknown or other
  modified_base (3664677)..(3664707): a, c, t, g, unknown or other
  modified_base (3664855)..(3665509): a, c, t, g, unknown or other
  modified_base (3665851)..(3666049): a, c, t, g, unknown or other
  modified_base (3666178)..(3666562): a, c, t, g, unknown or other
  modified_base (3666784)..(3674156): a, c, t, g, unknown or other
  modified_base (3675047)..(3675199): a, c, t, g, unknown or other
  modified_base (3675479)..(3676043): a, c, t, g, unknown or other
  modified_base (3676267)..(3680330): a, c, t, g, unknown or other
  modified_base (3680699)..(3684565): a, c, t, g, unknown or other
  modified_base (3693839)..(3693928): a, c, t, g, unknown or other
  modified_base (3694034)..(3694150): a, c, t, g, unknown or other
  modified_base (3694298)..(3694429): a, c, t, g, unknown or other
  modified_base (3694681)..(3694684): a, c, t, g, unknown or other
  modified_base (3694831)..(3694987): a, c, t, g, unknown or other
  modified_base (3714855)..(3714883): a, c, t, g, unknown or other
  modified_base (3724797)..(3725979): a, c, t, g, unknown or other
  modified_base (3727526)..(3727584): a, c, t, g, unknown or other
  modified_base (3761606)..(3761692): a, c, t, g, unknown or other
  modified_base (3851715)..(3851772): a, c, t, g, unknown or other
  modified_base (3898999)..(3900622): a, c, t, g, unknown or other
  modified_base (3913437)..(3913565): a, c, t, g, unknown or other
  modified_base (3988742)..(3989593): a, c, t, g, unknown or other
  modified_base (3990797)..(3992279): a, c, t, g, unknown or other
  modified_base (4018482)..(4018498): a, c, t, g, unknown or other
  modified_base (4019655)..(4019667): a, c, t, g, unknown or other
  modified_base (4021052)..(4021150): a, c, t, g, unknown or other
  modified_base (4022630)..(4022779): a, c, t, g, unknown or other
  modified_base (4023213)..(4023588): a, c, t, g, unknown or other
  modified_base (4035587)..(4035669): a, c, t, g, unknown or other
  modified_base (4035704)..(4037455): a, c, t, g, unknown or other
  modified_base (4039030)..(4039121): a, c, t, g, unknown or other
  modified_base (4040876)..(4041066): a, c, t, g, unknown or other
  modified_base (4062012)..(4062203): a, c, t, g, unknown or other
  modified_base (4095038)..(4103413): a, c, t, g, unknown or other
  modified_base (4123601)..(4123883): a, c, t, g, unknown or other
  modified_base (4125321)..(4125365): a, c, t, g, unknown or other
  modified_base (4125476)..(4127668): a, c, t, g, unknown or other
  modified_base (4129766)..(4134136): a, c, t, g, unknown or other
  modified_base (4146966)..(4147099): a, c, t, g, unknown or other
  modified_base (4171054)..(4176434): a, c, t, g, unknown or other
  modified_base (4176590)..(4176615): a, c, t, g, unknown or other
  modified_base (4177944)..(4180911): a, c, t, g, unknown or other
  modified_base (4181015)..(4182198): a, c, t, g, unknown or other
  modified_base (4184818)..(4184847): a, c, t, g, unknown or other
  modified_base (4187258)..(4190945): a, c, t, g, unknown or other
gcgcatagtccggcttgtttttttggaaaaatgattcgctcctagatccatgcggatagcggatgacggtgacagcccggtttttcagaaatgggagcagatagtcactgacttcaatcatatactgaataaaatcttcttttgtttttttattcttttcaaatatgattttatccaggcttgtgaactggagctttgggtgaaccggtttggagtgtcgtatgacttgcgcatatgtgcattcggtccagtccatttggaattcgaaaccgataaacgatacctctcttaatgtgccttggagaattgttaagtattgaacagctgcacaaatcgaaggttcaagcgtaaattcgcctgagggtgtttgctgtccgtgctgttccataatctcgcgtatagcgcttttttcctcatcgcgcattccgtgcgagacagaggcaatcggtgtcattattccgttttttaacacagataccgtcagaaacccgttgttagggttgaaccctgttatgcaaacataagcttgtttaaagtttttatatttgagccaatcggacgaccgcttcttttcaagccatttgctgtttgttttcttcgctacaattccttctccgtcatattttattaccatctcccagagttgatcaaaatgatcataacagggaatggattgaatggtttcttttgcgtaaggatctggagatgcaggaagctttgctgcggatatgagttcacgcagcgattttttgcggtccaaatacgaaagaagcgttacatcttctccgcttcgctctaacaaatcaaaggcgagaaagcagcacggccgcgcgtttgccgattcctgaatcttgtctggccttttcaaacgcccccgcacttgaaggtgttcaaaatctgcacgacaaggattcaccaaacatacgatttcaccatcaagtgtcagcggaagctctttttccatgtgctgaaaggcagttttggcgaattgtgtgatttcagggaaggtgctgctgagctccacaccatttctgctggttaaggtcacacctgaagaatggatgcggagaatacagcggtacccatcatattttacttcgtaacgccattctgctccgattggcggtgacgaagttaagaccggctgcatggtaaacgccatgggctatggcgtgccggaggctttttttctagttgttttttgttttttatctccggctcctttcggttcagcggcttgtgcaggtgcggcagccggtgtctccctgttcggccttctggttctgtcaatgctggcttgcagagcgcttaccagatcaatgacatcttcacgaggtggcgctttatcaggagtgacggccgtttctttattttctagcttgtcgttgactctttgcagcagcgcctgtcggtacgtgtcttcatatttctcaggttcaaactcagcagtcagttcatctattaatgtgatagcggtttgcagttccttatcgtttacattcgattgatcaggtacacctgggacatgagcggcgcttctgacctcatccggataatggatagactccatgacgatacaattttcataaacgcggagaatcgccagctgctgctttgacctgattgtcatattggcgataccgatctttccggttgagcgcagcgcctcacgcagcagggtataggccttcgtcccattatccccggggccgacaaagtaggagcggttaaagtaaatcggatcaatttcctgaagctgaacaaagtcaacaatctcaaccgctttctcctcatgctcctgttttaagctttttaaatcttcgtctgttagtactacatatttcccttttacatattcatatcccttcacaatttcatcaggactaagagttttttcgcaatttgtgcaaactttctcgtatttgattggtgcgtgatcctctttatggaggctgcgcagtttaatatctttatcttctgtggccgcatatagcttgatggggatgtttactaatccgaagctgatcgatcccttccacattgtatgcatatcgataaacccctttttttctttagtgtgaagagaaggagtacgattcatgtgtagtaacttatgggtgaaaaaaagccggcgctgttattgcgatggctgttcaataatgaattgttcgaattgttccggaggtattggcctgctgaaaaagaagccctgcaaatggtcgcagcctttttcatatagaagctgcttttgagctgcattttccacaccttcggcaatcacctgcaaagacagctgatgccccatggcaataatagctccggtaatttgctctgatttaggatgggtctgaatatcgtcaataaatgatttgtcaatcttcagcctgtgaatcgggaagtccttcaaatagctaagggagctgtgaccagtaccgaaatcgtcaatactgattctgattcctaattctgtaagggatgacaaaacctttttggagtgatcgagattgtccattgtcatgctttccgtcacctccacttcaagaagctgcggaggaagctggtatttattaagcgtatccttgatgaggggaatcagatcttcggattggaactgtctggcggaaatattaatggcgacagaaagatcatagcctttgtcgtgccaaatccttgcctgcttgcatgcttcatctataatccactttccgatatcaataataagtcccgtttcttctgcgacaccgatgaattctccgggcggacgcagttggccgtctggtgtcacaaggcgtatcagtgcttctgctcctgtcattttttgtttttttacactgaattgcggctgataatgcaagacaaatctatcgttttcgattgcttctctgagtaccatctcttggttaagcttgacggtttctttgttgccaattgaaaaagaatagtatctgtatttgcttttgtttcgttctttagccgcatacatcgccatatcagcctttttcatcaattcaaggccatcagtcccgtcttttggagatatcgcaatcccgatactgacagatgtgacaagggtgtgatcttgaatcttgaaaggtttttgaatttttggataatttttcttgctaaaacatctgcttcgcctgttcctgtattggcgtctgttaatataataataaattcatcaccgccaagacgggcgataaatccgttatcagggactacagatgacaaacgtttagccgcaaactgaagcagttgatcgccgacattatgccctaatgcatcgttaatcactttaaaccggtttaagtcgagaaagaaaacaacggtgttataatgcaaggtatgctcgcgattcagtacctttgttagatgagagatggcatgtcttctgttaggtaagtctgtaagcgaatcataatgagccattctatggatttctttttctgctttgtactgcttcgtcatgtctttgcaaatgacataaatgctgtccagttcttgattgacctcaacaggtatgagcgtaatatttaagtgaaactggcctttttcagtgataagttcgctatcgctgttcatcgcttgtttatcttttttaacttgctcaaaaaggcgcttaatcttctgtgatgtgtaattcctccagtcatgcatgctgaagccaaatttgctgatcatttcctcaccagcgtgattggaagatattatgtctccttctaatgataaaataaagattgcatcaatattgtggacgattaaagactgaaatcgctgttcgttatcctttatgcgttcgctctgtttaataaactttcgatctgcatgggaactgaataacaataacgtttggatacaaaaaataattaaagtaacaaaaattgaccaatgaaacgtttgcacctccatatggcttccgggcggagccatgtccttatggaaagttgccgcaagcatccctgtgtagtgcatgcccgaaatcccaatgcccattacaattgaactgacgactttatagaatataagatgctcagaatgtttttttacggccaagtcaaagaatatttttaacgagacgaaagaggctgcaatcgcaatgataattgaagctgtaaataaaatcggttcgtaaataatcattacccgggaaatggcagacattccgatatagtgcatagaagcaatagatgcgccaagcacaactgatccggtaagcagtctgtaatatgtaagaatgtaccggctgacaaaatataatgacacaaatgatcccgaaacagatgcgccaatggctgccattaaaggcatgaattcatattccatcggcatttccatatggaccgccatcatccctacaaaatgcattgaccaaataccgaatcccataataagtgagccgccgatcagccaaattttactttttaagcctgtattgatggtgactttccttgaaagttcaagggaaatatacgaggcggtacaggcgataagaaaagataaacatatgagcgtcgtattatatgtaacgtgtatttccaaatggagattccccccgtatcgtgtgttccagtcttgttgactctctttattatcggctgcttaaccgcagagtttcagccttcaaaacgatagaaatacgagggagatctatttttagttcaactgaccgtgaaaaatgtgttaaaatcatcttgacgttttccgaaaaaacaaaaatgtatgatacataaacatgaaacaagggagttggtggctatcgaagagctggttatgtcatggatagaagcatttaaaagcttatcttattttggaatatttctagcgctcagtattgagtttatcccggccgaagtcgtcttgccgcttgcgggctattgggtatctaaaggcgatatgacacttgccggcgttgttttggcaggatcgcttgggggagtggccggtccgcttacgctgtattggataggccggtacggaggaaggccgtttcttgaacgttttgggaagtatctctttattaaacctgaagcgcttgataagtcagatgaatttttcaaaaaacatggaggctttgtcgccttcagcggccgtttcttgccaggcatcaggacattgatttccataccgtgcggaattgcaaaaatgaatgtttgggtgttttcgctttatacattcattgctatgcttccgattacatttgtatatgtttatctcggtgtgaagctcggtgaaaattggaaggaagtcggctctattcttgatcaatatatgcttccaatcgggatagcgattttggcgctgttcctgctctacttactgatgaaaaagaggaagaaacgcacgcactccgaacaattatctgtatttttgaaaaataaacgttgacaaatcattgcgctgcgcatatcattgacgtataaaatcatatttcttgaaatcccaaaggggagtagcgtccggaatgtattccggaaacaaagtcgtcatttcatggattgtatccatcggctttgttggcatgcctgaattcatgtctagcaagacctttgccttatgtcggcaaaggtcttttttgcatggtccggccggcataagatcggatgaagagaaagaaaacaacttttttgggagggtatcatttatggatgcagcattattattagagtatggttgggttcttctcgtcttgatcgggctggaagggattttagccgccgataacgcgctggttatggcggtaatggtaaaacatttgccggaggaaaaaagaaaaaaagcgttattttatggattggcaggggcttttgttctgcgatttggctctttattcgccatttcatttttggtcaacgtatggcaggttaaagcgattggcgcgatctatttgctgtatatctcagcaagccacttattgaaaagatatgtatttaagaaagaagacacacataaagagacgaagcaaagcggtttttggccgactgttttaaaagttgaactggcagatatcgcgtttgctgttgattccatcttagcagcagtagcgctggcggttacacttcctgggacatcactcccgaagatcggcggacttgacggaggacaatttctcgtcattttggccggcggtatcatcggactggtgatcatgcggtttgcggcttccatgtttgtgaagttattaaaggaacgtccaagcctagaaacagcagcctttgtgattgtcggctgggtcggagtgaagcttgctttatatacgcttgcccatcgcgatatagcggttgtttctgagcactttatccattctggaacatggaaactaatattctggggtgtcttagcagcaatcgcggtttgcggctggtttatgtcaggtgggaaaaaacagccggagggcgcacaaaacgaacaaaaaaacagcacccgtgaacgggcgtaatctgaaagactctgcttaaaagcagagtctttttgtgtttgaagcgttttcataagcgaaataaaataacatttttataacatctttgttacaaaaaacacgcataaaacccccttaattctttagaaaggcacgaaatcatgtataggacgtcagaatggtttgtcataattgagacattggaaatcaatatttctttttctcctttgcgaatccctatcaaattagctatcattaatgagtagttatagggaggaactgaggtgaaaccagtgcttagccttttgtttaaattgggaaaaaagaagcaaacacttgaaaaagctgttgagagtatacaaaaaggcaataaagatctgcaaaatgaattaatacagcaatataagccatttatcgcaaagacggtttcatccgtttgtaaacgatatatagatgaaaaagacgatgagttcagtattggactgatcgcgtttaatgaagctatagaaaaatattcacctgaaaaaggaaattctctgctcgcatttgctgagcttattataaaaagaaaagtcattgattacattagaaaagaagccagaagcgcacaaaatataaatatcgatttacaggaaggagacgatcaggagtcatcacaaagcctgattgaagccgagctttccatagatgaataccgccgtcagattgaacaggagcagaggcgggaggaaatcctctattttcaaaagcagctcaaggattatggtttatcgtttaaagaactgcttgaaaattctccaaagcacacggatgcaaggcaaaacgccataaaggtggcaatgacgcttgttgaacatgaagaattggccgctatcctgtatacaaagaagcagcttccggtcaaacagcttgaacagcttgtctctgtaagccgaaaaacgattgagagaaacagaaaatatattattgcgatgtgtattatcattacgggtgattatatttatttaaaagattatcttaaaggggtgctgcactcatgagaagagggattatagtagagaaaaataaaaaattcgtcacgttgctgacccctgacggacaatttttaaaagccaaaaatgatcgacacagctatgaaatcggagaagaaatcatccttccgagtgaaacacgcatgggcagaagggccagcttttttgatttttttaaactgcgccctttcaaaatggggatttttacgatgactgctattatgctctttatttttatagttctccccgttttttctaataataaggcctatgcgtatatgacaattgatatcaatccaagcgtcgaaatggcgttaaacagcgattatgaagtgattgaactgacgcctctaaacgatgagggacagaaagtcgtgaatgatatagatgattgggagaagactgattttaaaaaggtgattgacgatattataaccgactgcagtgaacacgggtatgtaaagaaatcgaaagaaatattgatttccactgtttatgaaaacacagaagacaatacatataaaaaggctgtgaaaaaacagctgaatgatgtgactgaaaaatataaaacgacataccgcatggaatctctcgagtcagatatgcaaacgagggaaaaagcgaagaaagaaggcgtctcaacaggcagctacatcaaatcaaatgaaaagaatgacaataaagatttaaaagatgactccagcaaaccatccggggaagaggatcaaaagagtgatgaaaatgaggatgaaaacaacgatcaaactgacacccaggacagcaagcaaggagataatgaacagctgaatgatgcggattccggagaccagaaagaagataaagcggatgaccagattgatgatagtgacaaagataaaaaaataaaggaatcagatgaaaatacaaataccgaaaaagatggggaccatgagcaaaccccaatacaagatcctcaagataaaggaaatgaaaataacggcgctgacaagggtcaaagccaatatcacagggactggaacaatggtgaacaaggcaagaaccgttcttcgtccagaagggataacgcttcagaccgacgtaatccaaacggctacagcagtgataataattcagctcaaaatgaagattcgccgagtgcccccggcgaataaagacctgaatttatttagttgtgccatttaattgtgattgtgcttgctgtaccagccgctttgtcatttctccgcctacagagccgttagcgcgtgcgactgtatcagaaccaaggttcacaccgaattcttgagccacttcgagtttaaattggtctagtgcctgctccacccctggaacaacgagtttatttctgctcgccatctttttcatctcctttttcgataaagaaattcttaacgcgtatttagtttgaaatatacggggtttatttatgctggcaattgttgtggagaaaaataaaaccccggcctctgagccggggtgacgcagactatagaatgtctgctgtcattttatgtgcggttgcctgaatatggaacgtcaaaatggagagaactgtaatggcgataatttgtctgattttaagccattggccgtcattcagttcttcaaaacggtgacggagacgctctgtctcctgttcggcgatctcctgtagattggattctttcatagaaggagtatcttggtgatggatggcatcaagcacatatgcgcagctttcataataagcaatcgggctgatgacatcatcagatctgtctgagattgtgttaaaggccacttttaaaatagcccgtatgtgttcaaagtcataaatggattttaaatcacgtacaattaaaagaataactgcctgttcaattgagtattttttgcctagctcagggtgtccgatcagatctttgatatcacgctttacccagttttgaatcgcggttgactttaacgaagtcagctcgcataagttgccaagctctacgatttcatttgtagaaagaccgtattcttttttctgtttttttcgttcatatcttgtaagaaattcaggaatttctagatgattggctgctttttctgctgacatgttcgctgattggacgagaatgtcgagcgggctatgttctccttgtccttttagggaatagagcagccgcaccatatcggttcgagagagtttaaaaatgttcattgttcacctctttaaacaatttgacgcggatataggtctatgtataagttcaaagttcaagcgtcagcaaattacattaacatcatacgtcgaattccttgcattttcaaatggatgttttataatttaaatatacgggttcttttgaacttaaaataacggaggttgttatggcgaaaagaatttttctgtttattctaacgaatattttggtgcttacaacaatcgggatcgttttgtctgttttaagctctgttacaggagtcgggacgtactttacagctgatggcggtatcgatccaatggcgcttcttgtgttcagtttagtcgttggatttgtcggttcctttacgtctcttgcgatgtccagatggatggcaaagacgatgatgggcgtcagagtgctgaatccgaaaaaacactcgctcagctatgaggaacagcaattggttgatcgtgttcacagattaagccgctctgccggtttaacgaaaatgccggaagtcgggatttaccgttcacctgaagtaaacgcgtttgcgactggaccgtcaaaacgccgttcacttgtcgcagtatcgtcagggctgctggagcagatggatgacgcagcggttgaaggtgtgcttgcccacgaggtcgcgcatatcacaaatggtgatatggtaacaatgacgcttttacaaggtatcgttaatacctttgtcgtctttttatcgcgtatcgccgcttggatagcaagccgttttgtcaaagaagatctagcgccgatcgttcattttattgcaatgattatttttcagattgtcttttcgatacttggcagcctggttgtgtttgcgtattcacgccatcgtgaattccatgctgacaggggaggagcggatcttgccggcaaggacaagatgattcatgcgctgcggacgcttaaaagctattcttcccggattatggaagacgatcagacagctgtccaaacgttaaagattaatggcaagaagcgctcttcacttttctctactcaccctgatttagatgagcgaatcagacggctggaagctaaataatacaaacacattgttcctctgagagaattctcagaggttttttattttatccattgactaaaatcataaaaaaataagcaagttaagaaaatgtttcgtaaaagcctttaaaaatggacctaatatctttagaataattaccgtacttaaaaagagaggcagaaggattttacatgagattaaagtttggaaaattgatacaggccttgtcaccggcccagctgatcgcattatattattttcttgcagttactgtggccgttatattgctgagtttgccggcggcccataaacctggggcggattggacgtttattgatgcgctttttacagctgtcagttcagtcagcgtaacggggctgacggtagttgatacagctgatacattcagcacaatagggatttttatattagcatttgttctgcaatttggcggaatcggaattatgacgctcggaacgttcatttggctgatcatgggaaaacgaatcgggctgaaagaacggaagctgattatggttgatcaaaaccaatcccagttttcaggaattgtcaatctgatgaagcaggtactgtttctgatcttgtggattgaattttttggcgggctgatactcggcacatatttcttaacctactatgactcctatcaggaagcctatttacacggattttttgccagtatcagtgcaacgacaaacggcggatttgatattaccggtaattcgatgattccatttcgccacgattactttgtgcagtttattacaatgcttttaattatatttggagcgattggatttcccgtgcttgttgaagtaaaggatttcctgttttcaaagcatcggcgttatccatttacgctttttacaaagatcacgacgattacgttcggctcacttgtcttgtttggagccattggcatctttgccctggaagcaaaccatgcgttcgcaggaaaatcatggcatgatattttgtttttgtccctgtttcaatcaacggcaacccgaagcgggggactggcaacaatcgatatcagccaattatcagattccacactcttttttatttgtgcgctgatgtttatcggagcgtcgccaagctcagtcgggggaggcatacggacaacgacttttgctttgaaccttcttgcgctgtttcattttgcccgcggcaataaggccgtaaaggtattcaaacgggagcttcaccctgctgacttgatgaagtcgcttgttgtcacgatgatggcgatcctgctcgtttttggcgcgacactcattctgaccattacagaaaaacattccctgctggagcttttgtttgaagtgtgctcggcattcggtacaaccggcctgtcgcttggaattacggcagatttgagcagtgttggaaaatgcgtcattatgattgtcatgtttatcgggcgaatcggcatcctaaccttcctgtatctgatcggaagaaaggaaattgaagcgaactatcactatccgaaagaaagagtgattatcggataggcaaaacaccgcatactttgcggtgttttttgattgccaaaaaaaagatgtgtgcctcctgttcagttggagaacctaacttcgacaggtgcaatttacgctcctgcatcttaaaatgtctgaaaactggcgaggaggattcgtatgaagcgtaaagctgaagtgaatgaagccattaaaaataacaatacacctaccgagagcatggaccccaattcatataagacacaatatcatgacgaccccaattttagaggggcaaaccgcaattccaaacagggccagcagggaggcatgtagttgtgaagaaaaaccgtcatagcagagacatgcaaaatcataaaaagcctatgaataaaaaggtgctggaggaagagttctcaagtgaacttggggattacaatgccgggaagatcatcgaaacgctggaagtcaccaagcctgaaaagaaaaaagaaaaaaacaaaaataaaaaacaaaaataaaaaagacctcttaggcggcgtccgcttaagaggtgctttttctattttaaataagcatttttgcccgttcctctgacaaattgcaataagctggtcatcctcagctcaatgaagggctgagcgactgtcttaacaaagttgctggagaggactgatgtcagggctgctgttaaaagcaagaggatcactaagctttgatagtcagtaagccaatcctcaagcccgacctgtcgtaatgtcttaataataaacccgtgaagcagatacacgtaaaatgtccgggttccccatttggtaaagaaataccgtttttgcggaacaagcgctaaaaagctgaaggttgccccaaaggcgagtacataccagccgattcgggatagtccgcttaccagggtaacgtctccaaatgaagaatacggttttgaaccaaacagaaaagaatagtcaaaatcgatgccccagcagatgacgaatactgcggcaagcactccgagcgcaatttgtttgccgcgttttgatctcaataaatcaaaatgatgtttatttaaataaaaaccgacaaggaacatcggtaagaatacgaatgtccgtgacaagctcagcgtgctgctgacaaagtccagataaccgatcagcacggcgattccgcagctgacaaacagcgcccactgctttgaaagctttgaaaaaggatataggagcaggttccaaaagaataagcttacaagaaaccataacgaccattgcggatcaatcgggttcacatttgccatgctttcatcttgcataatgtaataaaagacggaataaatgatttggaaaatcaaatacggaataatcagcttgaccgccagcttttttacatatcccgcccgtttaaagcctttcgcgaaataaccggatacaagaataaatgcaggcatatggaatgtgtaaatgaacttgtagaggtagagcataaaatgattatcattaataaaggaacgaaggatatgaccgaatacaacaaggaatatcaataaaaattttgcgttatcgaaataactgtcccgcgatttactcatagcatcaccttctctttcatcagtcactaagagattattccctgctggtacatattttaaaataaaagatgaaaaaggaatctaaaaaaatgctgattgttaggtcgatgtaaagtgatggtaaggatcgtagaaaatgtcttcgtaatgtaatggcgctgaaattttctgaaatttatagggcaaatgaaggaagttcccgcattttgtagaaatattgagggataggttttgaagaaggagtgtacatgcatggaaactcttggtgtccagacaaactcggagctgcgagaggaactgaatcgcctcaaagaagaaaacgcgcgactgaaaaaggaattgaatcagcatcaagtgattgtcaacaatacgctcgatgctatttttatttgtgataacgaaatgcggattgttcaggcaaatgaagcaacagaaaggatgcttcaagttgactcggaagatttgaaaaagcgttctgttttggattttttgttttcaattccaaaggatgaactgaatctttccgtaaagaagttttttaaaaaaggctttctgtggaaggaggttccgatcaggcttgattgcggggcaacaaaatacatagagtttctggccaaaagaggtattggtgaggatttcttttttgttgtcatgagggacatatcttctaagaagattctggagcgggaattctctatgaatgaacagctttttaaggacttgtttgacagagcagttgacggaatcgtcctgtttgataaagatggcggttttattgatgccaatttgtccttttgtaaaagctttgaaatcaatcataatgagctgtctcatttatctttgtatgagttcatagacagcggctcacgaaaagatttcgacaatacctggaaggcgctcaaccgcaagggaaaagcgaagggggagctgcctgtcaagcttcgttcaggagttcaaaaactatttgaattcacgattacatcaaacatcatcagcggtttttatatgtccattatgagggatatcacagagaagcggtctatggagctgcagctctttaaaagtgaggagcgcttcagagaaatctttgaaaatgcaatggacgccatcatcatctggtcgaatgacggaagaatcgtaaaagcgaatcaatcagcctgtaaaatttttgagctgccgatgaatttgctgttgaaaagaaagctgtgtgattttctcgttgactcgcagcagaaatacagcataacgaaaaggaaatacgcaaaatacggagagatcagagaagagctgctgtttcaaatggggaacgggcaattcaaagagcttgaatttacttcaaaacggacaatccttgaaaatcagcatttgacgatcttaagaaatgtaagcgacagaaagcggatggaaaaggagcttcgggaaagcgagctgaaattcagaaaagtgttcaacggctcaatggacggcaatgtattgttcgacaatcaatacaggatcattgacgccaacccgttagcaagccatattttgggcctgtcacatgaagagatcaaacagcacagcctgttagatattatttctgcttatgaaatagaaaatctggcatcaccggcaaggcagattaattttgatgaaatggataacgaaattccatttttgctgagcagcggtgataacagaaaactcgaattctcatttaaacggaatattattcaaaatatgaacttggctatctttaaagacgtaacagagcgaaaagaattggaggagcgcctgcgcaaatcagatacccttcatgttgtcggcgaactcgcagccggcattgctcatgaaatcagaaatccgatgactgctcttaaaggcttcattcagcttctgaaagggagtgtcgagggagactacgccctttacttcaacgtgatcacctcagaactaaagcgcatcgaatccatcatcaccgaattcttgattttagccaagccccaggccattatgtatgaggaaaaacatgttacccaaattatgagggacacgatagaccttctaaatgcgcaagccaatctcagcaatgtacaaatgcaacttgatttaattgacgacattcccccgatttactgtgaaccgaatcagctgaaacaggtttttatcaatatattaaaaaacgccatcgaagtgatgcctgacggcggaaatatttttgtaacgataaaggcattggatcaagatcatgttctaatctccttaaaagacgagggaatcggaatgacagaagataaattaaagcgacttggtgaaccgttttatacgacaaaggaacggggaactggacttgggcttatggtaagctataaaattattgaagaacatcaaggcaagattatggtagaaagtgaagaagggaagggcaccgttttccatattacgcttcctgtcagacagaatgctgaagaaagaaggaatgatgaatgaactactatacgacagccgaaacgccgctcggtgaacttatcattgccgaagaggaggaccggatcactcgtctatttctcagtcaggaagattggatggattggaaagaaacggttcagaatactgagcataaggaaacacctaatcttgcagaagcgaaacaacagcttcaagaatatttcgcaggcgaaaggaagacattctccctgccgctcagccaaaagggcactccttttcagcaaaaagtgtggcaagcgctggagaggattccatatggtgaatcccgaagctatgcggatattgccgctgcggtcggcagtccgaaagcggtgcgcgctgtcgggcaggctaataaacgtaacgacctgccgatttttgtcccgtgccacagagtgatcggcaaaaacagtgcgttaacaggatacgccggaagcaaaacggagatcaaagcatttttgctaaacatcgagcgaatctcctataaagaaaaataaaacatatggcacgttcccttttttcacggccgacatatcattttattaagttaaaaaagttggtctgatgaaaaaggaggacaaagcaattgaagccgagccgctctgagaaacttgccgtttttgccgaactgtttgtgaaactgcatatcttatcaagcgctcaaaaagatgaaatcatcaatgttaacaaaaagaaacaaaaaaaccgctgactcggctccaaatgagcaaagtccagcggttttttaatgcaccttttctcctttaaacagctgttcaatctcttcttcatagtttccggtcataatccctttttctgtgatgattcctgaaatgagatcatgaggtgtaatgtcgaaagcgggattaaagacaggcacattggatggagcggtccgaactccggaaatctgcctgacttcctcgggatctcgttcctctatcgggatatcagcgccgcatttgacctttgtatcaaatgtagataaaggtgcggcgacaaaaaacggaatatcaaaggcgtttgctaaaatagcaagaccgtatgtgccgattttatttgccgtatcaccgttctttgcaattcggtcggctccgacgataacagcggaaatttgtttttccttcatcgtatgggcggccatgctgtctgtgatcagagtgacatcaatgcccccctgcatcagctcccaagcagtaaggcgtgaaccttgcaggacaggccttgtttcacaggcataaatgtgtaatcccaaatctttttgtttggccaagtaaaacggagctagcgccgttccatagcggcttgtcgcgattgagccggcattgcagatcgtcatgatcctgtcgccttttttgaaaagctgcagggcgttttggccgatcaaccggcacgtttcctcatcctcgacctgaatctgaatggcttcatggacaaggtttgtttttgcttcatttacggaaatcgcgttttcgaccgaatgactcagtctctcaagcgcccatgacaaattaatggcggtaggccgtgagctgtttaaatattgtttgatgtcttccagtctgcggcggaattccgtgacattgtctgtttcaatgtctttggcagcaagcgccagtccgaaggcagctgtaatgccgatcgccggagcgccccttactttgagcgtgacaatcgcatcaaatacatcctctttcgtcgtcagctccaaatattccgtctcatcaggaagcttttgctgatttaaaatggtaatagctgtttctttccattcaacagaacgtggaacagcaaatgaatgggtcatgaatagatcattcctttacaagtaacttaaataattcaataacatctgttatcgttttgaattccgaacgtttttcgataaaggctgtgccggtttcgagcgccaagcgttttctgccgattcgtttatcaaacggcacgatcgtatccaggtcagctacatgggcaaggccgatcgtgcgtcgtatcagctcacagcccgcaaatccgattgcttcttcaaaaatatggctgagagtatcagtgaggtaaccgtcgatgttggcgtatacatccagactgtccttctgccaggcttcactaaacgtctcttcaaacgtttcccagacctggttgacatgttcatataacggctctctgtcagccccgtcacggctgagtgcgttcaaaaataagttggcgataaattgccctacatcaaagccgatcggtccgtaaaaagcaaactcaggatcaatcacctttgtttcgtgctcacttgcgaaaatgcttcctgtatgcaaatcaccatgaatcaacgtttctgcagacgttaaaaatgactttttcagcttagcggcttcgattttaacgctgtcattattccaaagcttttcgacaaaaggacgaagctcttcttcaaaatcatttgtgtcatggtcgaagaaaggatctgtaaaaacaagtctttccgtaatgtcgcatagctctggatttgtaaactgtttaacaagctgttttttcaccttaggttcaagcgcgtaatctgatgagtagaaaagtgtttttcctaaaaattcaccgatgtgctgcgacagatgaggatagttttcaccctcaatgagtccttttcttgcgatcttgaggtgagagagatcctccatgacggtaaccgccatttccgtatcagaataaaacactcttggaaccaggtgaggcacatgctcgccctgacggatgagagcgctgctttcgattcttgcacggtcgattgtcagcggccagctttctcccaccacttttgcatacggaaccgcctgtttaatgatcaatgctctgtcatgttcttgatcataaatatgaaaaacgtaatttaagttgccgtctccgatctcctggcatgtcagcgtgcttttgcttggaaaaaggccaagcttcaccgccaacgccacagcggagctttcatttaacgtttcgtataaaggtgtttttgtgactcccatcatcataacctccaattatgtaatcacttaatatgtagccgtaaaaaagcctccttctcagagagaaggaggcttaacatctatgtccgcctctcttatctctcagatcagatctgaatggaattagcaccgtgccttaagagaccagcgtctcggcgcgaaaaagatgcgccccatttcacaatggaattacggtcggttgctgttggggtcaaaaggccaaatccctcgcccaactctcgataagagaatatattcacttgtttgacaattctaatttatcagttgatgaacatggtaacaggtaatttagttagttgtcaatatattttttaatataaatcttttctgatatcatcgaaaacaggaatgctctcccgaacttctgcgctttcttgaaggtcgatttccgctcggactatgccttcttcccgaccgccttcagcaagtacacgcccccatggatcaataatcaggctatgtcctgcaaattcattatccggatttgaaccggtacaattgcaggctgcgacaaagcattgattttcaatggcccgcgcaataagcaggcttttccaatgatcaaggcggggaagaggccattccgcagaaataaacagcacgttggcgccttttgtcgtatgttttctgatccattccggaaaacggatatcgtaacagatcaatccagagcttttgacgccgtcaagctcaaagtatccgtcttcggaaccggctgataaatacagatgctcatccatcagctgaaaaagatgggcttttctgtactctttaatgatttgcccttccttatccgcgatgtacattgtattataaacatcagaattcttcctgacagcgaccgatccggcgacaatatgaacaccatgtttttttgccgttttcttcagccagctctgagcggagcggccgtcttcatcagcgagttcatcaagattggccagatcatatccggtcgtccataattcaggcagaacaagaacatcagcatgtttgctttctttttcgatgaaaaattcagccttttttatattttccgaaggttttccgtatgaaatatcaaattgaagacaagatatcgtccatttcatctttttaacaccccaaatttttctttacttttttcatttaaccatatatgatgatggactatcatttcaagatttttttagaaggagagaatagatgaaatttgaacagtctcatgtattgaaggaattgcctaaacaattcttcgcttctttggtgcagaaagtgaaccaaaagctcgcagaaggacatgacgttatcaatctgggacagggaaatccagatcagccgactcctgaacatattgttgaggagatgaaacgagctgtcgctgatcctgagaatcataaatattcgtcttttcgcggctcataccgtctgaagtcagcggctgctgcattttacaaaagagaatacggcattgatctggatccggaaaccgaagtcgctatattattcggcggaaaagccggtctagtcgagctcccgcaatgcttgttgaatcccggtgatacgattttagttcccgatccgggttatcctgattactggtcgggtgtcacacttgcaaaagcaaaaatggaaatgatgccgctcgtaaaggacagggcgtttctccctgattacagcagcataaccgctgaagtaaggaaacaggcgaaattgatgtatttaaattatccgaataatccgaccggagctgttgctacttccgagttctttgaagataccgtgcgttttgcgactgaaaacggaatctgtgtcgttcacgattttgcttacggcgctgtcggatttgacggctgcaagcctttaagctttttgcagactgaaggtgcgaaggatatcggaattgaaatttacacgctgtcaaaaacgtataatatggcaggatggcgggttggctttgccgtcggaaacgcttcggtcattgaagcgatcaatctttatcaagaccatatgtttgtcagtcttttcagagcgactcaggaggctgcagcagaggcactgttagccgatcagacgtgtgtggcagagcaaaatgccaggtatgagagcaggagaaacgcttggatcacggcatgccgggaaatcggctgggatgtaacagctcccgcaggttctttttttgcatggctgcctgtgcctgaaggctatacttctgagcagttctcagatcttttgctggaaaaagcgaatgtggcagttgcggctggaaacggcttcggtgaatatggcgagggctacgtcagagtcggacttttaacaagtgaagaaagacttaaggaagccgcttatcgaattggcaaactgaacctgtttacccaaaaaagcattgacaagaccttataacgatgggataattcaaaataatttataaaatctatattttcttatcaagagcaggcagagggacgagcccgatgaagcccggcaaccgacttataaagcacggtgctaattcttgcagctagcggctgagagataagattcggacgagaaacgaaacctctttagacgcgattgcagtttgaagaggttttttgatatggatgaaaatgaaaggagctctggcatgagtgagttattagcgacatatctcctgaccgaaccgggagccgatacagagaagaaagcagaacaaatcgcaacaggattgacagtaggctcctggactgatctgccccttgtaaaacaggagcaaatgcaaaagcacaaggggcgggtgataaaagttgaggagagagagggaactgctgcatcagaaaaacaagcggtcatcacaattgcctatcctgaaatcaatttctctcaggatattccggctttgctgacaacagtgtttggcaagctgtccctggacggaaaaatcaaattaatcgatcttcacttctctgaagcatttaagcgtgcattgccgggaccgaagtttggcgtatacggcatccggaagctgctgggagagtttgagagaccgctgttaatgagcatatttaaaggcgtaatcggaagggacctgagtgatattaaagaacagctccggcagcaggcgcttggcggagttgacttgattaaagacgatgaaattttctttgagacaggtctagcgccttttgaaacaagaattgcagaaggaaagcaaatattgaaagaaacgtatgagcaaaccggacataaaacgctgtatgcggtgaatttgaccggacgtacggctgatctgaaagacaaagcgagacgcgccgccgaattgggagcggatgcgcttttgtttaatgtcttcgcttacggcttggacgttatgcaaggccttgcagaagatcctgaaatcccagttccgattatggcgcatccagcagtgagcggagcgtttacgtcttctccgttttacggtttttctcacgctcttttactcggaaaattaaaccgatattgcggtgctgacttcagcctctttccgtctccatatggttcggttgcgcttccaagagcagatgcactggcgattcatgaagaatgtgtgagagaggatgcttttaaccaaacatttgctgttccgtcagcaggcattcatcccggcatggttccgctattaatgcgtgatttcggcatagaccacattattaacgccggaggaggcgtacatggacatccgaacggtgcccaaggcggggggcgagcgttcagagctattattgatgcggtcctagaggcccagccgattgatgaaaaagccgaacaatgcaaggatcttaagcttgcgctagataaatggggaaaggttgaagctgtatgacgactcgaaaaccttttattatttgtgattttgacggaacaatcacgatgaacgacaacattataaatatcatgaaaacatttgctcccccagagtggatggcattaaaagacggcgtactttccaaaacgctgtcgatcaaggaaggtgtcgggcggatgttcggccttctgcccagccgtttaaaagaagagattacaagttttgtattggaagatgcaaaaatcagggaaggctttcgggaatttgtagcatttatcaatgagcacgagattccgttttatgtcataagcggtggaatggacttttttgtatatcctttgcttgaaggcattgtggagaaagaccgcatttattgcaaccatgcttcatttgacaatgactatatccatattgactggcctcattcctgcaagggcacatgcagcaatcaatgcgggtgctgtaagccgtcggtcatccatgaactttctgaaccgaaccaatatatcatcatgatcggtgattcggttacagatgtggaggcagcaaagctgtctgacctatgctttgcaagggattatttattaaacgaatgccgggagcaaaacctcaatcatcttccgtatcaagatttttatgagatcagaaaggaaattgagaatgtaaaggaggtacaggaatggctgcaaaacaagaacgctggcgagagctcgctgaagtaaaacgggaattggcagagagagattggtttccggctactagcggtaatctgtcaattaaggttacagatgagcctttaacatttctcgtcactgcaagcggaaaagataaacgcaaagagacggttgaagattttctgctggtcgatcaaaacggagagcctgctgaaagcgggcattctctgaaaccgtcagcagaaacgcttttgcatacacatttgtacaataaaaccaatgccggatgctgcctgcatgtccatacggtaaacaataatgtgatttcagagttatacggagaccaaaagaaaatcacattcaaaggccaggaaattataaaagcactcggcttgtgggaagagaacgcagaagtgaccgttccgattatagaaaatccggcacatatcccgacgctagcggcactgtttgcggaagagatttcagaagattcaggagctgttctgatccgaaatcatggtattacggcttgggggaaaacagcatttgaggcaaaaagagtgcttgaagcgtatgaatttttgttcagctaccatttgaaattgaaaacactccagcatcagctggttaaataaaaggaggaattgaaatggctacaattcgaattcatgatgaggcaaatacaacgattgaaaatcaagaggaagtggcaagctttctggacagtcaagaggttatttatgagcaatgggatatcacgaagcttccggaacatctctcagagaaatatgacctgacagaagaagaaaaacagcaaattcttgataccttcgaaactgaaattaaagatatctcaacccgccgcggctataaagcacaggatgttatttcattgtcagacagcaatccgaaacttgatgaactgcttgaaaactttaaaagagagcatcaccatacagacgatgaggttcgttttattgtaagcggacatggtatttttgtcattcaaggcaaggacggcacgttttttgatgttcgtttaaaccctggagatttaatctccgtgcctgagaatatccgccattacttcacgcttcaggaggaccgcaaagttgtcgcggtgagaatttttgtcacaactgaaggctgggttccgatttatgaaaaagacagcgtgaatcaataagcatgagatagccccgttcatcgaacggggctttttatatttattgcaaacgccacttttcatattgtgacagttcttttttaatcagtgtccaaatcaaacctaaaacagctgcatcgtcaatgaatccaagaccgaggattacgtctggaatgatatcgagcggcatgacgatatacaggattgcggcagttaacagcaaaagtgttttaacctgtgaacgagggtagtcgccatttcgccaatcgcgaagcatctgaaaaaaagtagtgatgtgttggatacatttttttcggtttttcctctttaaaatcgcttttccgcctgccgctccgagcattattgctttctttttcttcattgggcatacctcctgcctggcggcgtgtttaagatattcttcacctgggtattgttcttctaatcctatcaatatatctattatacctgaaaaattaacttatttaatgaaaatatgtttacaaataaagtataatctgtaataatgcacaataacccaatcaaacttgtttcctatttcttagcggcgaggggtgaagtgaatgggcggttcttctgaacaagaaagattgttggtgtctattgatgaaaaaagaaagttaatgatagatgccgctagaaagcagggatttacagggcatgacacgatcaggcacagtcaggagctggattgtttaataaatgaatatcatcagcttatgcaagaaaacgaacattcccaagggattcaaggccttgtaaagaaattaggcttgtggccccgcagagatgttatgccagcatatgatgcaaataaatagcggcctatcagatgcatatataaagagagagcttttcggaagcgctctttttttctggaaaaaattcatatgaaagagggaactaatgaaggaactggcgattctcattaccgaaatggtcaatcaatttcatgatgcttttatttccttatgcggaatatttggcattcatttaactgacaaagaaatgcatttttgggtgatcggcatttttggcatattctttttcggcgtcactcacgctgtgtttacatggctttctaaatggagtatgacagccttgtcctttatctataccgttacagtcatcattgtcatcgtatttgcgattgagattcagcaaaaggtgacggggagagggaatatggagtttttagatgccacggaaggtataaagggttttttagtattttttatgttttttttgcttttgaaaatgctgttgcgtttcatcaaaatccttttttctggaagaccagcaagcaaatcgaatggcaatgcccgatcacgaagataaaaaaccctcctgacatggtcaggggggctatgatgcggatacggggagggtgattgtcacctctgtgcctcttcgcacttcactttcaatatgaatagagcctccgtacatcagcacgatccgtttacaaacaacaaggccgagaccggttcctttttctttagaagtaacaaagggaaggaagatgtgatccagcatttcctgagaaatcccttcaccgttatccacaactttgattatggcttttttatctaaagctcctagggagatcgtcagtttgcctccttcaggcattgactcgaggccattttttgctacatttaaaatcacttgtttaatatgatcttttgtacattttacgagtaagggctgctcggttaaatactgtaattcgacttcaacattgtatagattgccctcagaataaatgatcggcataatttctccgataatgtcctgaagtgagttcagctcccatttttcagctgtcggcttgccgagaacgagaaactcactcactatttgattgatgcgtttgatctcctgttcgataatggagaagtaaagctgatcttcctcacctttatatttcttttgcaacagctgaataaagccgcttatcccggtgagggggttacggatttcatgggctgtgctggcagcaagcgtcccgatcagctctaatttttgcgcctcgttttctgagcgctccagctgggtctgccgcttcagcaaataatacagcacgagaataaaaaggatattcagcagaacaataatacatgaaagcggaagcacgaggcttttcgacagttcttctattgtgaccgggttcggatagactttcatattccagctgatatcatccagatatccgctgacaggtttctgatcctctgcatgagaggcttgtccgctcgcaaaaatcattttcccgtcttggttcacaacttcaatataaacatcagggctcagcaagttaatgagatttttcaaataatcaatttgaatagctgcgacaagataatctgtcacatttcgttttgagtccaaaacaggcacacaaattgtgaaaattggctgaccagtaattctgctagaataactatctgaaatgactgtctttttagtttcctttgcttttgtaaaaaaagatctgtcggccaggtttactttcgtttttaattcggttgtgcttgcggtgacgtctcctttggcattgagaaaatagagaccggaaaatctcggctctgaatcaaaggtcttttccaaaattgactgcattttctttatatcaaccggtctgtcgatggcgatggacaaggaggtcattctcgccattgtttctccgattaaataattgattttgttgcggtgaaggtttagcaggacacttgcttcttgtttatgttctgcagctattgtatctttttctttttcatatacgaaaaagctgatgacgattgccggaatcacgaccagtatgatataaagtttgactctcccgcaggcgccttttagtattttcaatttgcatcgctccaacatacacctgattagaggtattatatcattgtttcttcttctttaataagaaaaaataaccaaaaaaattagaaaaaggtgttggcaagcttacattttaaaaaagaagagaaatattggaaagatttttattgacattttggtctttgtttattaatgtttctctgtaacggtttctaaaaggatgattgagacatgacagaaaaatcactgaagttatttatcgtgctgtcgcgcgcgtatcggtctattaacgatcatatgaataagcatattcataagcatgggctgaatccgactgaatttgctgtgctagagcttttgtaccataaaggtgatcagccgctgcagcagattggagataaaattctcttggctagcgggagcatcacatacgttgtagataagctggagcaaaaagaacttctcattcggaaagcgtctcctacagacagacgagtgacatttgcgcaaattactgaaaaaggcatcggtcttttgaacgatattttccctgatcacgctgctgaaattgatgaaatgatcagcgtattaagcgaagaagaggtagagatgtgcaccgaaatgttaaaaagagtaggattaaacgcaaaacagtttcataataagtaaaaaaaggaagcctgatatgtcacaaggcttccttttttgctatttttcatttgtttccgctgcgcctcttggcaaaatgagaacttcaacccgccggtttttgcttcggccttccgcagttttattggaagccaccggtttatactcgccataacccttggcgctgaacacttttgcatcgagcttggggttttcaatcaggagccccataaagtttaccgctctcatgacgcttaaatgccagtttgattggaattcagaatttttaattggcatattatcagtatgtccgctgataatgatatttcttggcgggttaatcacaagaagatttgaaatctcttttgcaagcggcacatcttccttacggatggtcgcttttccagaatcaaagaagatgctgtctttaatcgtaatcagaaggccttcactagtcatcttcgtctccagctgatgttccagctttttatctttgatgaacttttccacctggctcttcacattttcaagttcttcttgatcagctgctttttctttttctttcttgtttttctctttctcttctttttcctttttcacttcatcgatgccgtctgactcgttttcaggaggagtgacactggagtagtccagtacaccggtgccgcctgtaaaaacttcattaaatgattttgagagcatttgaaacttagctgcgtcaatcgagctgctcgcgtacagcacaataaacaatgccaggagaagagtaaggatgtcggcgtaaggaacgagccatgattcatcaacgtgctcgtcctcatgcttcttcttcttttttctcgccattttgcgcctctccttgttctgcaaatttcaagcggtccttcgcaggaagatacattaaaagcttttgttcgatgactttcggtgcttgtccttctaaaacggataaaacaccttcaatcatgacctcacgcagttttacttcttgttttgattttcgttttaatttatttgcgaaaggatgccataacacataccctgtaaagataccgagaagtgtggcaacaaaggcggcactgatggcgtgtccaagctcatctgtgttatccatatgagagagagcggcaatcagcccgattacagcgccgagtactccaagtgtcggagcgtacgttcctgcttgtgtaaaaatagcggctccggcttggtgcctgtcctccattgcttcgacttcctctgtcataatatctcttataaattccgcgctttgcccgtcaacagccatgctgagcccgtttttcaagaaagcatcatctacatcctcaatgcttgcttctaaagcaagcagaccttcgcggcgtgcaagctgagcccattcagagaacataggaatgagttcctctattgtgagctgtttattttccttaaataacactcgaaacagcgtaggcacttttttaatttcttttgttgggaacgcaataacgactgctgagattgtcccggcgataataattaaaatggcagcggggtttgcaagggcgctgaaactgacgcctttcagaaccatcccgacgctcaatgccacaaaagcaagaataataccgattaacgaagttttatccatagtttttcaccaaatccttttttactagcttgtctatggttaatatcggttttggtgcccggaactttagggacattgtgaatttgttcatgaaatattcaaggaagaggcatagaagggagaaataaacaaaaacgggctctccaaaattgaaaagcccgggggtctactgaaattagcagcttgcttgcaagctgtccttcagatggtattcatataatagtagaaatacatattcactgtatataaacatgttccatccctccttaaaaaaagtgtaaaggatgaagggaagtagcgcttcaggggaagggacggtattttctaagtcaagagtatgaaagcataaaaaaaagcggcttcctaaaaggaaaccgctgattgttatttcgctcgcactttgattttatcatcttctaaaatcacgtgaaaacttgtgatctcgccattatcaagcagtagatcggtcatttcatcctcaacccattcttggatggttcttctaagcggacgtgcaccgaatgaagggtggtagcccagctcagcgattttttctttcgcttcatctgtcacattcaagctaatgccccgttcagccaatgtttcttcaagttctccaagaagaaggctgacgattttgacaagatgttctttttccaatgagcgaaactcaataatgctgtcaaaacggttgaggaactcaggtttaaagaacatgctcagtgaatcaatcaatgtttgttcttcgatgacactgtcatctgattggaaaccgacttttgtttgtttctcaccagcacccgcattacttgtcatgatgatcacagtgtctttgaagcttacggttctgccttggctgtctgtcagacggccatcctccataatttgcaggaacatatgctgaacgtctgggtgtgctttttcaatctcatccagcaacacaatgctgtaaggattgcggcgcactttctcagttaattgtccagcttcctcatggccgacatatccaggcggtgaaccgataattttagatacggcgtgtttctccatgtattcgctcatatcgagtcggataatagcgtcttttgtgccgaataattcgtctgccagtgttttagaaagctctgttttccctacgccggtaggaccgacgaagaggaaggagccgactggtctattttttgattttaatccggcgcggcttcgtcttaccgcttttgccactttttgaacagcggcttcttgtccgatcacgcgttcatgaagttttgcttcaagctctttcattttcgtttgttcgtctgcctgcagtttgccgacagggatgcctgttttttgttcaacaatttcctgaatgtgctcagcttccacagtgacagcggtatgagcggaggagctgttcagttttttctccaatgcgagttcttcatcacggagttttgccgcaagttcgtaattttcttcttccagggcttttgttttttcggcttcaattgcagttaagcgttcagcggcatcctcatcattcagttcatcaattaacaggttggcttttgaacctgcttcatctaataaatcaattgctttatccggcaggtgtctgtcctgaatgtagcgggatgataaagtgacacatgctttgattgcttcatcactgaatgttacgccatggtatgcctcgtatttgtctttaatcccttgcagaatgaggatagcctgttcaattgaaggctcctgcaccatgacaggctgaaaacgtctttccagcgcggcatctttttcgatttgacgatattctttcagtgttgttgcaccaatgacttgcagttcgcctctggctagagccggtttgagaatattgccggcgtccattgatccttctgcagagcctgcgccgacgagaagatgaatttcatcaatgaagagaatgacattttttcgttccttcagctcagtgatcagctgtttcattctctcctcgaattggcctctgatccctgtgtttgcaacaagggatgcaacatcaagcaaatatagctctttgtttttcagtttgtttggaacatcgccttcagcaatttttaaagcgagtccttcagcgatggcagttttccctacacccggctcaccaataagaaccggattgtttttgttccggcggtttagaatttcgatcactcgcgccacttcatcatcacggccgatgacggggtcaatgagaccggcttttgcaccgtttgtaatattttgagccagctcatcaagcagccctttttttccgctttgttttgctgcgctcttttctttcggctggaatgcctgttcaaacggaaatccgaaagattgaggacccatactcattgaaggtttacgggtcagttcgttatagcaagtttcacaaagaaccatctgtttatgaacggaatttatttgcatgttaaggcgaatcgtcgcctcgttttgatgacaatgttgacaacgcatttgccaaaacctccttaataatttgatcttctttgaccaatgaaagtgaataaaaaggtctattggatttgaccttctttgactattagtatacggcaaacttaacggcattcaaaccaatatgctcaaagcagactgaatatttgactatctttgaccaattggtttttaaaaaaggccggtttgtttgaccaactttgattaatagtatactctgactatctttgactttcaagtcttatgcacaaaaaatttttgatttgttacaaagtaaaacatgttttcttcgtcttttcaaggaacttgtctcataggttataaaaaggcatatatggacaaaactgcggttcgttcggagggaagaaatggaacaatcaaaagggtctgcaagtcagcttgcttttgtgtatgtcggcacagtagtcggagctggatttgcgactgggagggaaattgttgagttttttctgaagttcggctggttcggtttattcggcattctcgtcagcggcggaatgtttacgttactgggggccaagctgatgatcatttcaaagcgaatcaatgccaagtcatatcaagaaatgaacatatttttattcggggcgacggctgggcggattatcaatgtatttatgctgtttgttctccttggagttacatctgttatgctttcaggggcaggggcgctatttgaggaacagctggggatgtccgctcagattgggatgctcattacaatcggtctgagcttaattgtgatgactagaggagtaaaaggcattttcggtgtcaatgtgtttgttgttccccttttaatcatcttttcaatgattgtagtggccgactcttttatattcagcgaatcacgaaacgcagctcagtgggtctggccgcatcgctgggattggctgttatcagctgtttcttacggggctttgaatttatcgcttgcccaagcagttttggttccgctggcgaatgaaatgtcctcggagaaagtgatcaaaaaaggcgctttaatcggagggacgatgctgacgattgtgctgtccgcgagttttctgtctttgtcgactcttccggatgtatttttatatgatataccgatggcgcaagtggtttatctctttgcacgttctgtccatttgatttatttactcattattttcggagaagtgttcacatcagttatcggtaatctatatggattagaaaaacaagtgcaaagctttcttccagtgaaaagcaaatatatctttgcggccattatgatcacggcttatattacgagccaaatagggtatggcaagcttatttcaacgatttatcccttgtttggctatgtaagcctggccttcataggcgctttgctatgcaaaaaagctcctcggcggcgcagtttataaatatataatgaaacgaaccgtcactatagagcgataattgatctaggaaccggggactgacttttttattgtcaagaaaaacatcattatggtaagatagcagaagtgaaaaaattgaagaaaatccgtgcgatatgcgggagaggttctagctacaccctctataaaaaactaaggacgagctgtatccttggatacggccttttttatgtttttctagagcaccttccgaaaaaaggtgtttttttgcgtgaattagctgtagcgatgtctctcgccggcgtttttattgcggagaaggagaggaatcatgaaaaaagaaaaagcaattgtcgtatttagcggcggccaagacagcacaacatgcttactgtgggccttaaaagaattcgaagaagtcgaaacggtgacttttcattataatcagcgacattctcaggaaattgaagtggcaaaatccattgcggaaaagcttggtgtgaaaaatcatttgcttgatatgtcacttttaaatcagcttgcaccgaatgccctgactagaaatgatattgagatagaagtaaaagacggcgaactgccatccacattcgttccaggccgcaatttggtattcttatcctttgcgtctatcctggcttaccaaattggcgcgcgccacattattacaggagtttgcgagacagacttcagcggttatcctgactgccgtgacgaattcgtgaaatcttgcaatgtcacggtgaatctggcgatggagaagccgtttgtgatccacacgcctctcatgtggctcaataaggcggaaacgtggaagcttgcagatgagcttggcgcgctggattttgtgaaaaacaacacgctgacatgctataacggcatcatcgccgacggctgcggcgaatgtccggcatgtcaccttcgttcaaaaggttatgaagaatatatgatgatgaaaggagagcgtgcataaattgttatctcaaatttatccgcaggcccagcatccttattcgtttgaactgaataaggacatgcatatctcagccgctcattttatccctcgggaaagtgcgggagcgtgcagcagggttcacggacatacgtataccgtaaatataaccgttgccggcgacgaacttgacgattcaggctttcttgtcaatttcagcgtactcaaaaaactggtgcacggaaactatgatcacacgctattaaatgatcatgaagatttttctcagaacgaccggtattcgctgccgacaactgaagtcgtggcgaaaacgatttatgataacgtacaggcttatttagacactttggagaataagccgacctgtgtacaggtgtttgtccgtgaaacaccgacaagctactgtgtctaccgtccgaaaaagggtggtttgaatggctaaaggaattcctgtattagaaattttcggcccgacgattcaaggagaaggcatggtgatcggacagaaaacgatgttcgtccggacagccggctgcgattattcctgcagctggtgtgactccgctttcacttgggacgggtctgctaaaaaagatattcgctggatgacggcggaggagatttttgcggagcttaaggacattgggggagacgcgttttctcatgtgacgatctcaggcggtaacccggctctgttaaaacagctggatgcttttattgaactgctgaaggaaaataacatccgtgcagcgcttgaaactcaagggaccgtttatcaggattggtttacgctgattgatgacctgacaatttctccaaaaccgccaagctcaaaaatggtaacgaactttcaaaagcttgaccacattttaacttcacttcaagagaatgatagacagcatgctgtcagcttgaaggttgtcatctttaatgatgaagatctggaatttgccaaaactgtgcacaagcggtatccgggaatcccgttttatttacaagtcggaaatgatgacgtgcatacgacagatgatcagtcactgattgcacatttgcttggaaaatatgaagcgcttgttgataaggtagctgtcgatgcggagctgaatctcgtcagagtgctcccgcagctgcacaccctgttatggggcaacaaacgcggagtataatagaaaggaagatgaacatgacgacaagaaaagaatcagaattagaaggtgtaacattgctaggcaaccaaggtacaaattatttgttcgaatatgcaccggacgtgctggaatccttccctaataaacatgtaaaccgtgactactttgtaaaattcaattgtccggaattcacatctttatgtcctaaaacagggcagcctgactttgcgacaatctacatcagctacattcctgatgaaaaaatggttgaaagcaaatcattaaagctgtatctattcagcttcagaaaccatggtgacttccacgaggactgcatgaatatcatcatgaatgacttgattgaattaatggacccgcgctacatcgaagtatggggcaaattcacgccaagaggcggaatttccatcgatccgtacacaaactacggaaaacctggcacgaaatatgagaaaatggccgagtaccgcatgatgaatcatgatttgtatccggagacgattgataatcgttaattattccgttatgtgatatggagtgtgaaacgaggtgaggtcatggtaaaatccgaacattcaacgtccattttaggcgtaaatgtgacccggtcacannnnnnnnnnnnnnnnnnnnnnnnnnnnnnnnnnnnnnnnnnnnnnnnnnnnnnnnnnnnnnnnnnnnnnnnnnnnnnnnnaaaagtgtgacctgaggtgcaacctgaactgtgacttttatgcagtgaaaaattgatagtacagaagcagattaaggcgtacaatttgtacgtcttttcttttttatccgaaagaaaaaatgcctatctagagatcataggcattaaatattattatcaatatcttcatttattttttggctaagtttctgaaccttctctttaacaattgaaacagctcttttttgaatttcatcaaagttctcctgaatatagtcgatgacacttcttattagaaattcactttcaaaattgaatatttcatttatttctgactgttcttcatctgttaggtgatggtattgaagttgcttagcatttacttcagcagctacatcaatcctaacttagttgttctggttgtacaatttcatattcaccttctgcatactcttgctccgcataatggcttccccattgacagagctcctgcaagataggtttaagagattctccaagttcagtggatgaatattcaaccttcggcggtacttgattatacatctttctgctcacaagtccactggcttcaagctctctaagtgtttgaatcagcattttctgagttatatttgggataatgcgctttaattcactcgttctctttggtccattcattaaaaagtataatacaaggcctttccattttccgccaataacttcctttgtcacttcaaacccacaactaaattttttcatgtctaaagctctccattccacatttattactttttagttactatatcacaaaaaagtgggtacttccgataatgtgcttactgaaggatactatatcttgtaagttgttcttcaagtacttaaaggtactagacataaaataaaattaattctaaaggagtgttaagtatgggtaaatttgaaggtaaaatagcgcttgtaacgggtggaacaagtgggattggtcttgctacagcacaaaaatttgtaaacgaaggtgcatatgtttatatcacgggacgtagacaaaacgaacttgataaagctgttaaccaaattggcaagaacgtaaccggtgttcaaggtgatatttctaagcttgaagacttagacaaactatatgacattataaagcaggaaaaaggtaagttggacattctttttgctaatgcaggcatcggcaacttccttccattaggtgaaattactgaagagcaggttgatagaacgttcgacattaacgttaaaggaaccatctttactgttcaaaaagcattatcactattcccagacaaagtaggttctattattgtaacgggctctactgctggatcaattggcaacccagcgtttagtgtatatggagcatctaaagcagcattaagagcactggttcgcaactggattcttgacctaaaaggtactgaaatccgtgtaaatgtggttagtccaggaggtattcttacacctgcctacgatgagctttttggtgatgcacttgaagaggtactggaaaatagcagaaatactgttccagctggaaaagttgggacacctgaagaagtagcaaacgctgtatctttccttgcttcagacgaaagcagttacttgacgggtgttgaattgttcgtagatggcgggctagcacaggtataatttccctgcgcagagattacaaatagtccccaaaaaaggttgatggggatttacttgaagaagtcgtataaaaaagtcgttttccttaaaggacagggaattcgacttttttatgtttgaatttgattaacgttgtaaattcgcattttcctggggctaccaataaatgacctgtaaaaaagattacactgtgaataaatgtacttaaagtaacgggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctcttctaagcaatcattgggatcaggatttgggatgattggcaataaagaatcgagtgcttttggctcttggaatagaaggactagatttggacggagctaatatcgatatagaaaaccttccagaaaaagactggaagtaatttggattttattataattgtaaaaaagtatttctggagataaagaggtatcagttgcagtggcnnnnnnnnnnnnnnnnnnnnnnnnnnnnnnnnnnnnnnnnnnnnnnnnnnnnnnnnnnnnnnnnnnngcagattatcttatggttatggcctatgatgaaagccgccttgctgagcctaccgcaagtgtaggatgggtggaaaagtccattcaatatgttctgactcaaaaaatctctcctcaaaaactagttttaggattgccattctatggccgctgctggatggaaggccaatctgcctctcaagccattcccctttaccttgttgactcattagtaaaaaggcatagcgggacaattatttttgacaccaagagtcaatctccaaaagctatttttactgtcaatcacgataacaaggggccgttgccttcgggaacatatacattatggtttgaaaatgaacagtcactcagagcaaaaataaaactcgctcaaaaatataatctgaaaggtcttggcagctggagtcttggacaagaagatgcgtcagtctggaatacagtgtttaaaaatatataatgatttatagttcagaacaaaattcgaagataattgcaaccgaatctctaaatggacatactgaaaggagtttattacgagtgcgggtaaaacagtcgggcattccataggcccttctcccgaaatgttctatacgaggcattacattgggcttgaaatacacattcaaacttatgttatagtacgcatttcaagtaattacggatgtgttgaatttattcttcatgatttaagtcatacacatgctaccttaatagcaggattattgcatttcattcagaattgttcaggatcgatatggaagcgcacgaataactagaactttaaaaacatacactcatatacttcctgaaaggatgctggtttatctaaaaaaacatgatgagaattgattgtacgcatggtgaaacatgacttgttgataatcgaccatatagtttctccttagaaatgaggcggtttttacataaaaaagacgagcgaatccggggggaattccactcgccgctttctaatgaaaagacgggatgctggatggcagctcgtctgttttattataatttaacgaacgtatgtttgtaaagatgtcttttcgaatgaattggttcatataaccgttaagaacagattcattgtaaacattcgctaaggtatgctaagatgcatggactataaaggagtgatatgaagtgaagacattgcggttaaacaatgtaacgttagaaatggctgcatatcaagaggagagcgagccgaagcgtaaaattgcatttaccttaaacgttacgagtgagacttaccatgatatcgctgtcctgttgtatgaaaaaacgtttcatgtcgaggttccggaacgcggtcttgccttccggggggaaatgacaaattattcaacatcattgaccaacctgtacgaaccaggggccgtcagcgagttctatatagaaataacggaaatagacaaaaacgccgattcatgatcggtgttttttatgtaaaaaagctgccggccggcagcttttgagaaagcgaatttcatatgtaaggtgttaaattgtccgtcttgcagtttttttgaataaatgtggaaataaggaggttttaataggagtctctgatgatcttataatttttatgattaacaactgtcaatgaatctaactcaagatcccgatagttatccatgatcgtcacatcaacgataacagaattctcatttactttttcaacaacaccggttaatccgtttttaaattcaatgacattcccaaccttagcgattttcacaagcttcctctcctttaaacataataatgccttttgaaagtattttgcagtattttcattgagaagtaaagcgataaggagttttatctcccttatgaattgttctgtcgctataaagatgatatattgattttcgtcaatagaaagaaaaggggggaatttttgttgcgtcccgaagaaataacagaaatgattgaacagctgcgcaccggcgccataaacgaactgagagtccagaaagagcattttcttgatttcagggccgtgttatctaaacaagatgattttaaacatttccgaggaattgcccagcaaggcggagatgttatctttcaatacttagaacagccaagaagctgaaggtttctcatacgtgagaagcctttttatcatatatgacagaatacaagccttttattacagctgtctgtaacaggtgtaaataaaatgtaaagttccaaagatggataaacatgttttgatttgacaatatttatagaatttcagactgtttttttgccattaagcagtgagtcatcctctttattccatcctgatacctccttgggagagttggaaaatctttttccgtgaaaatgaatggatctcttgttaaggttatgaagtgttttttggagcactttaaggaggaaactgtatgacaacgaaattcactgctctggctgtttttcttctttgtttcatgcctgcagccaaaattgagcatacacaagcttcactactgagcgcaaagaagacaaaacatgaagaagcgaaatggcttacacatatagatcgaaatacgaatgaatctttcccttcactgtctgctgataaagacaagaaaataaaaccgattaagctatcagcacacactgaaaagaaagagaaagataaaccggacaaaacaaatgatgagaaagaaacatatacacagtctgaaaaagagttgctgtcccgtctcgttcacgcagaggccaaaggagaatcatataaaggcaaggtcgctgtagcaagcgttgtactgaacagaacggagaaaaaaggttttcctgatacgataagaggagttatttatcagaaaaacgcctttgaaccggtcgcaaacgggagcattaaccaaaagcctgataaagaatcgattgaagctgccgaagaagcgctgtcctcaaaaaatagagaaacagatgccatattcttttataatccgaaaacagcgtcagataattggattcgttcaagaaaaatcgtagaaaaaatcggcagacacgtttttgccgtctaagcatagaagagacaatttgtctcagctgtgctttttttcatataaagagtaaaaataaaataatttttgaacttgtctcatatgatgttggtagtacaagagacaaggagagacaccatgaatcgatttgtgaaagggatcattcttttatccattgccgcctttttcgctgaatgccttgaatttgtcgtcaatatgattttggcgcgggagcttggcgagcatgggatggggctttacatgagtattttgcccacgatctttttaattattgtcatcgcgagcctggaactgccgatatccatttctaaattcattgccgagtcaaatcctaagcttcatgaaagtatgctgaggcacgctttcagaatgacagccatatttactgctttttctactgtcgccgctagtattgcgcttccgtttattccggtatttgatacataccacccgtttattaaagggattgtcatcggcttaattcctgttgtcgcctttacctcaatcgccaggggctactttatgggtgtgcagaaaatggggaagatcgcaatcgccaatgtgctgaaaaaaatcatccagctcttgtgcttattcctcttttttcaatggtactcatttgaattggacatggctgtgctggtttccttgtttgttctagtcgtgagtgatgtggtcgtgcttgtttacttatattcacaatttatcatggcaaggcgggcgttatccggccagcagcacattcatttgcgcggaaaggatgtaaggaaaagactgcttgctgtttcaattcctacaacaggactgcgtatttttcatgcggttgtcaatgcaattgaaccctttttagtaaaaggagctcttttggctgcgggcgttgccgggacagcggcgatcgatcaatacggaatgctggcaggagtggctgtgacgatagggtcgttccctgcttttattgcccattcgttaatggtcgtcatgataccgagtatttcggaagcttatgcgctttctcagtatgacatcgtgttaaaaaggctgaagcagtcgattttcattacattaggttacggtatacctgccgtctgggtcatgttccagtttgcgggacctctcacgcatttgttttttcactctcctgaagcgcagtattacttgcagctgttgtggccttactttctctttcatctgtttgtcatgccgctgcaggcgtgcttaatcgggatgggttttgtgaaagaggctttttatcacaatgtatggagccatatcgttgcgctaagtatgatgtatgtactgggatcaatggagaatctgcaaatgctcgggattatccttggaatgaacactggcatgattcttttgatgagcctgcactatgccacgatctgcaaagcattgaaggtatccgtatttcttacgggagggaccagaacgccgcgaattgaaggatgataaaggaacagcaggggcaagctaattgaaaagcatgaaaggaagattccatgttaacgaagcgcttgcttactatatacattatgttattagggttgattgcatggtttccaggtgcggcacaagctgaggaaaaacagcctgctgttcccgctgtttttcttatgaaaacgatagaaggggaggacatctcgattccgaataaagggcaaaaaacaattctccatttttggacgtcatggtgtccgccctgcaaaaaggagcttccacagtttcaatcgttttatgatgcccatccatccgacagtgtaaagctggtaacggtgaatttagtgaattcggaacaaaatcagcaagtcgttgaagactttattaaatcaaacaagctgacgttcccgattgtccttgactcaaaaggggaattgatgaaggagtatcatatcatcacgatcccaacatcatttttgctgaatgaaaagggagaaattgaaaaaacaaaaattggtccgatgacggcggaacaactgaaggaatggacggaagaatagctgagagcatcgactctcagcttttttcatatagagaagaagtgaataaacattaatgataattattatcaaaaagaaattaaaataattataattgaaattctcttcgtgcgtgctataataaaggaagacatcaagaaataactaacgataaagctgccttttgggcagcgattttgtttttataagagaaatgaagatgatttacgttctcaattagagaggagaattcgatatgaatgaacaagttatcgttcaacgcgacccgcatgagccattgaaaacagacaagagggaaaaaaactgggcacagcacgcggaacttattgcagcacttgtatcaggcgctcttattttggcaggctggctcttatccggatatcaggtattatccataatacttttcttgctggcttttgtgatcggcggatttgctaaagcaaaggaaggaatcgaagaaacactcgaatccaaaacgctgaatgtagaacttttaatgattttcgctgccgttggttccgccttgatcggatactgggcagagggtgctattttaatatttattttttccttaagcggagctttagaaacatacacgatgaataaaagcagcagagatttaacgtctttaatgcagcttgagcctgaagaagcgacgttgatggtcaatggtgaaaccaaaagagttccggtttcagacttgcaggccggtgatatgattgtgatcaaacctggagaacgcgtagcggcagacggtatcattgaatcgggctcgacaagtcttgacgagtcggctttaacaggtgaatcaatgcctgtagaaaaaaacagaggcgacgctgtattcacaggaacggtgaatcgcaatggctccttgactgtccgtgtcacgaaagcaaatgaagattcgttattcagaaaaattatcaaactggttgaatcagcgcaaaatagtgtttcacccgcgcaggctttcatcgaacgatttgaaaatgcttatgtgaaaggtgtgctaattgcggtggcgctccttttattcgtcccgcactttgcgctgggctggagctggagtgaaaccttctaccgcgcaatggtgtttatggttgtcgcgtcaccttgtgcgcttgtcgcctctattatgccggcggcgttgtccctgatttcaaatggcgcccgcaacggtatgcttgtgaaaggaagcgtctttcttgaacagctgggctcagtgcaaatgatcgcctttgataaaaccggcactgtaacaaaaggccagcctgccgtagagacgattagaatagcagaaggattcagtgaagcggaagttcttgaggctgtctatgccatcgaaatgcaatcaagccatccgctcgcccaagccataacggcgtacgctgaaagccgcggcgtgaatcagtccggctacatatctatagaagaaacctcagggtttggcgttatggcagaagtgtcgggtgcgaaatggaaggtcggtaaagcaggttttatcggcgaggaaatggcagcacaatttttgaaacaaacagcatcagatgtcattcaaagcggtcatacaattgtatttgtgaaaaaggatgatcaaatagcaggctgtatcgcactgaaggaccaaatcaggcctgaagcaaaagaggtcatggaagaactgaaccgacttgggattaaaacggccatgctgacaggagatcacgaagacacggctcaagcgattgccaaggaagccggcatgacaactgtcgtagcagaatgcctgcctgaccaaaaagtgaatgaaatcaaacggttaaaagaagaattcggaacgattgcaatggtgggtgacggaatcaatgatgcgccggcgctcaaagcggcggatgtcggcattgcgatgggcggcggaacagatgtagcacttgagaccgctgatatggtcctcatgaaaaacgatttgaaaaagctcgtaaacatgtgccgcttgtctcggaaaatgaacaggatcatcaaacaaaatatcgtgttttctctagctgtaatctgcctgctgatttgtgcaaactttttgcaggtgatggaattgccatttggcgtgattggtcatgagggcagcacgattttggtcatactaaacggtttaagactcctaaaataaaaccagcagccctaatcaggctgctggctttttatgtatcaagctttcccttcatttttgtctttatcagatcttttcataaccaggatgagagcgaggatgcagcaaaggaaacccgctgcacagcctatgatagagctgtaataataaaagcccaccatcttcatcccgataaaaggagcggaaattcccaaaaccgttaagagcataactgcttttcgtctgaaaaaattcatcagcaaacggaacaacccccctgcgattgaacgttactgtcagtatacaggaagaggagcaggaaataaaatgcattagaaaatgaaggcgtcgtgaaaggcaaacaccggtaaaacctgttacaatggaagacagaacaatgcattgcaaatggcagggaggaacaagaagtgaatagaatacaacgcgtctcttcatggctgaaggaagcggggcatactgccgcatttattcatacaaaagaaaatgttttttacttaaccggtttttacacagagccgcatgaaagattaatggggttatttgtttttcaagaagaggagcctttctttgtttgtccaggaatggaagcaggacaggcccgcaacgcaggctggaatcatgaaatcattggctatgcggatcacgaaaatccgtgggagctgatagagaaggccttgaaaaagcgaaatatcagcatacatacgcttgcggtagaaaaggattcaatctcgctatcacgtgcagaacagctgaagcatgcgactggcggggctcaatttgtttcagcagaagaaacactcaatcaatttcgcctgattaaagaagacaatgagattcgtttgctgaaagaggcggcaaagcttgcggattacggtgttgaagtcggtacagccgctttgcgtgaaggcatcagtgaagtggaagtgctcgctcaaattgagtatgagctgaagaaaaaaggaattcagggcatgtctttctctacaatggttttatttggagaaaaatctggccagcctcatggaaatcctggtacagccacgttgaagaaaggtgattttgttttatttgatctcggtgttattcttgatggctattgctctgatattacaagaacgtttgcatacaaaaccatcaattcgaagcaggaggccatttacgagactgtgcttcaagcggaaaaagccgcgattgaggcaagcaaacccggtgtgagaatcggagatctggatttaacagcccgcggaatcattgaaaaagcgggatacggtgactattttcctcaccggcttgggcatggactcggaatttctgtccatgagtatccatcaatgagccaggccaacgatacactgctgcaggaaggcatggtctacacgatcgaaccggggatttatgtgcctgaaatcggcggcgtgcgcattgaggatgacgttcacgtaacaaaggacggggcagttgctctgacccaatatccaaaggaattaatcatactgccgtaataagaaataaaaaaggactttgttctcgacatcgtccttttttatctgcattaaataaaaaaatcatcaaatgttcgaaagggtttaatttcatgtttttggttgagaggttttacagcaagacagctgccaccgagaacagtgagacataacccaattaaaatgaagaaacccatgtgatcttctcctttcagcttaaaacacaaaaagatatctggtacgtccatatcatattgtatgaaacgcattccagatcaaggggatttagaaagaagggaatctatggttaatattaaagacattgcagaaaaagccggtgtctctgttacaacggtttcccgagtcataaacaatcatccatacgtcagtgaagacaaacgaaaaagagtgtttgaggcaatggaatcattggagtacacgagaaatattcacgctgtacatttgtcgaaaggattttcaaacatgattggtgttgtcttgccgacggttaatctgccatattttgcagagctgattgcaggaatagccgacgcagccgcggaatccggggttcacctctctttattccaaacaaactatgaggtacaaaaagaaatctttgcgctgtcccaattaaagcagcgccaggttgacggcctgattttttgctcaaaggcgcttgctgatgagaaactcatggaatgggagggcccgattttgctttgccagaattcagataatgcccgcttcccaaccatcagtattcctcaccaagaagcatttcggaacggcttggactatttaattgccaaagggcacaaaaaaatagccatctgtttggcaagaaaaaaaggcatgaacagtcattttcgaatcaaagcctacaaagaggcattggaagagatcggtgaggcatttcgtgaagactgggtaattgagaaagcgattacaatcaatgatgggaaggcgctttttcataaatggaatacgtggaaggaaaagccgacggctatttttgttgccaatgaccaagtctcagcagggctttttcttgaagcaaagaaccagcgggtgtcagtaccggatgagcttgcaatcttaagcgttgataaccacgaaatcagccaagcgcttggaatcacaacgatcgatattcagacaagggaaatgggaaagcaggcatttgccatactggaaaaaagaattcaaggacagccgattgaaaggaaagttctggattaccgtctcgtcgaaagatcgactgtttagtgaatgcattgaaaaaaggtttgacgtgcattctgttcgttatgtacgatatgaggtattgaatgacaaaggagctgaggatcgtgaatgggtccttcacagtgaaaaaggtactgaataataacgtattaattgcttctcatcataaatacagcgaagtcgttttaatcggaaaaggtattggtttcggaaaaaaacaagatgatgtcattgaagataaaggctacgataaaatgttcattttaaaagacgagaaggaacaaaagcagtttaaaaagctccttgactatgttgatgaaaagctcgttgatatttcaaacgatgtcatctatcacataagcaataggactaatcactcattaaatgaacatattcacattgcgttgacagaccatatcgcatttgcgatcaaaaggcagcagcagggatttgatatgaaaaatccatttctaatggagactcagtcactatatcctgaggagtaccaaattgccaaagaagtcatagatatgatcaatgaaaaagcgggaatctgccttcctgaaggggagattggttttatcgctctgcatattcattcagcgttgacaaaccgtccgctgtcagaggtcaatcagcactctcagctcatggcgaagcttgtcgaggtgattgaagactcatttcaaatgaaagtaaataaggaaagtgtccactatttgcggctgatcaggcatatcagatttacaatagaaagaattaaaaaagaagaaccgactaaagaaccagaaaaattaatgttgttattgaaaaatgaatatccgctatgctacaatacagcttggaaattgattaaaatcttgcagcaaacattgaagaaaccagttcatgaggcggaagcggtttatctgacgcttcatctgtaccgattaaccaataaaatgtcataaattcagtttatccttataacgtgttactgattcgatcaggcatgagtgattgagggaaaaaaacgggaagttcattctcgttcttttgcgcacccaattttgctcatgcctttttgttgtgtaaaagggcaaatgtaaacggttaaactggaagacttacgcctgtgaattcgttgtcatgatttttagctgtaaggtcagactagtaaaaagaggaggtcaattcttatgtttaaagcattattcggcgttcttcaaaaaattgggcgtgcgcttatgcttccagttgcgatccttccggctgcgggtattttgcttgcgatcgggaatgcgatgcaaaataaggacatgattcaggtcctgcatttcttgagcaatgacaatgttcagcttgtagcaggtgtgatggaaagcgctgggcagattgttttcgataaccttccgcttcttttcgcagtaggtgtagccatcgggcttgccaacggtgatggagttgcagggattgcagcaattatcggttatcttgtaatgaatgtatccatgagtgcggttcttcttgcaaacggaaccattccttcggattcagttgaaagagccaagttctttacggaaaaccatcctgcatatgtaaacatgcttggtatacctaccttggcgacaggggtgttcggcggtattatcgtcggtgtgttagctgcattattgtttaacagattttacacaattgaactgccgcaataccttggtttctttgcgggtaaacgtttcgttccaattgttacgtcaatttctgcactgattctgggtcttattatgttagtgatctggcctccgatccagcatggattgaatgccttttcaacaggattagtggaagcgaatccaacccttgctgcatttatcttcggggtgattgaacgttcgcttatcccattcggattgcaccacattttctattcaccgttctggtatgaattcttcagctataagagtgctgcaggagaaatcatccgcggggatcagcgtatctttatggcgcagattaaagacggcgtacagttaacggcaggtacgttcatgacaggtaaatatccatttatgatgttcggtctgcctgctgcggcgcttgccatttatcatgaagcaaaaccgcaaaacaaaaaacttgttgcaggtattatgggttcagcggccttgacatccttcttaacggggatcacagagccattggaattttctttcttattcgttgctccagtcctgtttgcgattcactgtttgtttgcgggactttcattcatggtcatgcagctgttgaatgttaagattggtatgacattctccggtggtttaattgactacttcctattcggtattttaccgaaccggacggcatggtggcttgtcatccctgtcggcttagggttagcggtcatttactacttcggattccgatttgccatccgcaaatttaatctgaaaacacctggacgcgaggatgctgcggaagaaacagcagcacctgggaaaacaggtgaagcaggggatcttccttatgagattctgcaggcaatgggtgaccaggaaaacatcaaacaccttgatgcttgtatcactcgtctgcgtgtgactgtaaacgatcagaaaaaggttgataaagaccgtctgaaacagcttggcgcttccggagtgctggaagtcggcaacaacattcaggctattttcggaccgcgttctgacgggttaaaaacacaaatgcaagacattattgcgggacgcaagcctagacctgaaccgaaaacatctgctcaagaggaagtaggacagcaggttgaggaagtgattgcagaaccgctgcaaaatgaaatcggcgaggaagttgtcgtttctccgattagcggggaaattcacccgattacggatgttcctgaccaagtcttctcagggaaaatgatgggtgacggttttgcgattctcccttctgaaggaattgtcgtatcaccggttcgcggaaaaattctcaatgtgttcccgacgaaacatgcgatcggcctgcaatccgacggcggaagagaaattttaatccactttggtattgataccgtcagcctgaagggcgaaggatttacgtctttcgtatcagaaggagaccgcgttgagcctggacaaaaacttcttgaagttgatctggatgcagtcaaaccgaatgtaccatctctcatgacaccgattgtatttacaaaccttgctgaaggagaaacagtcagcattaaagcaagcggttcagtcaacagagaacaagaagatattgtgaagattgaaaaataagggtgttagtacgccgtgcttgtcagatgacaagtacggttgtatgatataatattgtgaagtaattaagctttaagttaaaaggagaatgataaaaatggcacaaaaaacatttaaagtaactgcagattctggaatccatgctcgtcctgcgacagttcttgtacaaactgctagcaaatacgacgctgacgttaatttagaatataacggcaaaacagttaaccttaaatctattatgggtgttatgtctttaggtatcgctaaaggcgctgagatcacaatctctgcttccggagctgacgaaaacgatgctcttaacgctttagaagaaacaatgaaaagcgaaggactcggcgagtaatgcaagaattaaaagggattggtgcttcagccggcatcgcgattgcaaaagcataccggcttgaagagccagatttaacggttgaaaagaaaaacatctctgattctgaagcggaagtaagccgttttgatgaagcgattgcacgttcaaaagaagagctcgaaaaaatcaaagagcacgctttgaaagaactgggtcaggataaagctgatattttttctgctcaccttttagttctcagtgaccctgagcttctgaaccctgtgaaagaaaaaatcagcactgattcagtgaacgctgaattcgctttaaaagaaacgtcttctatgttcgttaccatgtttgaatctatggacaacgaatatatgaaagagcgtgcggcagatatccgcgatgtaacaaaacgcgtaaccggccacctgcttggcgttgaaattccaaacccaagcatgatctcagaagaggttattattgtagctgaagacttaacaccgtctgacacagcccaattaaaccgtgagttcgtaaaaggattcactactgatatcggcggacgcacatctcactctgccatcatggcacgttctcttgagattccagcagttgttggaacgaaagcggctacaggcacgatccaaaacggcgtgactgttatcgttgacggtatcaatggcgatgtcattattgacccatctgcggaaactgtaaaagagtatgaagaaaaacataatgcttatttggctcaaaaagctgagtgggcgaagcttgtcaatgaaccgactgtctcaaaagatggacatcatgtagagcttgcagcgaacatcggtactcctgatgatgtaaaaggtgttcttgaaaacggcggagaagcagttggcctttaccgtacagaattcctttacatgggaagagatcagctgcctacagaagatgagcagtttgatgcttacaaaacggttcttgagcgtatggaaggaaaatcagtcgtcgtgcggacacttgatatcggcggagacaaagagcttccttacctgcagcttcctaaagaaatgaacccgttcctgggatatagagcgattcgtctttgccttgaagagcaagaaatcttcagaacacagcttcgcgcgctgcttcgtgcaagtacatacggaaacttgaaaatcatgttccctatgattgcgacagttaacgaattcaaagaagcaaaagcgatccttcttgaagagaaagaaaagctcgtaaaagcgggacaggctgtatctgacgatattgaagtcggaatgatggttgagattccgtcaactgcagtcatcgctgatcagtttgctaaagaggttgatttcttcagtatcggaacaaacgatttgatccaatacacaatggcagctgaccgtatgaatgaacgtgtatcttacctgtatcagccatacaacccggcaatccttcgcttaattacactggtaattgaagcagcacacaaagaaggaaaatgggttggcatgtgcggagaaatggcaggagacgagattgcgattccaatccttctcggcttaggcttagatgagttctcaatgagcgcaacgtctatccttccggcaagaacacaaatcagcaaattgtctaaacaagaagctgagtcattcaaagagaaaatcttatctatgagcacgacagaagaagttgtcgcgttcgtaaaagaaacattcaagtaatgtacaaaaaccagacggcctccggcctgtctggtttttttcataagtaagggtatagaaggacacaataacatggctaggagggatagtatgtcaaaccaatttaacgcaggagatactgtttatgtgatctacagaaatccgcacgccgccaatgtagctcacataaaggaagccgaaattgtgcaccatccataccatgaaggcgagctttccctgtttatttatgaaacctatcacccgttcgcagaggacgatgctgtgtttgcaagctatgaagaagctaaatcgctttacaaagaactctttgatattgatccatatgagtaacaaggaaatcattacaactcatatcctttccgcctagtgagaaaagtaacgttagtaaaggaaaaggatgtggcatcatgcagaacccatttgttccgcagcttgtatatatagaaccgagggcgctggaatatccgctaggccaagaattacaagaaaaatttgagaatatgggcattgaaatcagagaaacaacatcccacaatcaggtgcgtaatattcctgggaaaaatcatcttcagcaatatcgcaatgcgaaatcaactttagttatcggtgtccggaaaacattaaagtttgattcatccaaaccctcggctgaatatgccattccgtttgcaacaggctgcatggggcattgtcattactgctacctgcaaacaaccatgggatcaaagccgtatatcagaacttatgtaaacgtcgaagagattttggatcaggcagataagtatatgaaggagcgcgcaccagagttcacaaggttcgaagcatcatgtacgtcagacattgtaggaattgatcatctgacacacacgctgaagcgcgccattgaacattttggtcaaagtgatctcggaaagctccgatttgtaacgaaatttcatcatgtcgatcacctattagacgcaaagcataacgggaaaacgagattcagattcagtattaatgccgactatgtgattaaaaactttgagccgggaacttcacctcttgataagcggatagaggcggcagtaaaagttgcaaaagcaggctacccgctaggctttattgttgctccgatttatattcatgaaggctgggaagaaggatacagacatctgtttgaaaagcttgatgctgctttgccgcaggacgttagacatgacataacgtttgaattaattcaacaccgttttacaaaaccggccaaacgagtgatagagaaaaattatccgaagacgaagctcgaattagatgaagaaaagcgccgttataaatggggacgctacgggatcggaaaatatatatatcagaaagatgaagagcatgcacttcgagaagcacttgaatcctatattgatacctttttccctaacgcgaaaattgaatatttcacttaaacgggctgttgtgatcaacagctctctttttataaaaaggatttttccattccatcaaaacgccgtaattcaatgattctttatcctctacataattgcttactacacgaataggtgaacgcccgcaacggaggagaaaggacagtacagggtcgtttttcctgccttccatcacatcttcaacgtactgaacagcgctgatctcgtgtgcgtatttatgatataaaggaatgcggccgccgccgagaaggcgctccagtctcttatcaacagtcagctcatacatcgtattcatcagccattttccgattccaagctttcgataatgaggagaaacagaaatatccactacatataaagtatttccatgaggttcatgatttttaatcgatccgttgtctgttgcttgtgcccaagtatgatcaggagattcaggctcaaattgtacaataagagcagtcatggaaccgataattctgccattgatgagcgcgcataaagcgccttccggaaaggttttgatatggctgacaagctggtcctctgaccacagcaattcctggggaaacggaggagggaaacattcttcttgaagagaaatcagcctctcgatgtcagtctcagtgtagtttctgatggtcagagcctcaaattttctgctgtcgcgcacatacatttgttttagtatgatcatcactctccttatgttgtttcattataacgaagattgaattttcagtaaatatattccgattttcttataatttattttttgattattcatttttcaaacgaaagggccgatatagaaattaggaggggattggtttgtttaaaaaacttcacatgaagattgctgtttttgtttcgattatgttaatcgtcacagttgttcttttaatgctgtcttcttatttgacgctaaaaccgatgattacagaggatgggaaaaatacaactcaaaacgtgacgcagtcacttgaacaaaatattgaattgcaattaaagagttatgccatttcgttatcaagattggctaatggggaattaacgcatacatttgtaacgaaaccaagtaaagaagttgctcggctgtttcacgatgacattaagcaaatcaaagataacgatgattatgttgcgatggcttacataggcaccgcaaaaaaagaaatgtttacatatccaaaagcggatttcgctgaggattatgatccagcatcaagaccatggtataagcttgcagctgaaaccccggatcaagttgtttggacggaaccttataaagatgtcgtgacaggagacatgattgttactgcatcgaaagcgatcttagacgggcaaaaagtgataggggttgccagctatgacttgaaactctctgctatccagagtatggtcaataaacaaaaggtgccttacaatggatttgcctttttagctgatacgagcggcaatcttttagcccatccgtcaaatcaaggaaaaaatatatcaaaggatcaaacactgcaaaccatcgcatccgagaaaaaagggatacaagatgtgaatggaaaaatggttgtgtaccaaacgattggcgaaacgggctggaaggtcggaacgcaatttgataccgatcaattaatgtggatttcagataaaatgaatcgggcaaatctttggatatcattgcttgcgcttatcataacaattattctcagctacttcctggccaaaacgataaccggtccgatacagcagctgatcgcaaaaacgaaagctgtttccgcaggcgatttaacagtgcgcgcggaatcaaaatctaaggatgaagtcggtattttaacaagagatttcaatctgatggttgaaaatatgaaggaaatggttgagcaagtgagactctcttcagggaaagtatctgacacctctgaacaactaacggctgtctctgccgaaactaatgaaacaagcggacaaattgcaaaagcgattgaagaagtagccgcaggagcatcggaacaggcttctgaagttgaaaccattaatgaaaaatcggaaagcctgtcaacgaaaatcaggcaaatcgctgaggaggcaggcggaattaaagaacgttcaaaatcgtccgaggatgcaagctataaaggacttgacgcgctcggccagctgctgatgaaatcaaacgaagccaatatggaaacgaaaaaggttgaaacgatgctgctggatttggaaaatcaaactaagaatattgaagaagtcgttacagcgatttcaaacatatctgatcaaaccaacttgcttgccttaaatgccagtattgaggcagccagagccggagaaagcgggcgcggttttgccgtcgtagccgatgaagtgcggaagttagctgagcaatcagccctttctacaaagcatatcagcgagactgtgaagcttatccagcttgagacaaaagaggcctctcacgcgatggttgaggcaagcagaatgaatgatgaacaaaacagtgccattcacgaaactggagaggtattaaatacgataactgcagaaatgcagtcactggtacaaggtattgatcacatttacgcggaaattcaaagaatgagtgaagaacagcttgcgatttctgaagctattcaaagcatttcagccatatcacaggaatcagctgccgcagcagaggaagtgaacgcatcaaccgatgaacagcttgtcacccttgataaagtcaaacactcaacggaaacactaaaacatgcaagccaagaacttatgaacacaattgcaaaattcacattgtaatccaattacatccccaaacatcatttgttttggggattttttatgttataagatgaatagatatggtagtctaaaaaatgaaggaaaaatgataaattttaactaaaatcaaaacgaaacatcagggaggaatgaccttgaaaaaaacaattggttttatcggtcttggagtgatgggaaagagcatggcatcacatattctgaatgacggccaccctgttttggtgtacacccggacaaaagaaaaagcagaaagcatacttcaaaaaggcgcgatctggaaagatacggtcaaagatctttcgaaagaagcggatgtcatcattacaatggtcggctatcccagtgatgttgaagaagtgtatttcggaagcaatggaattattgaaaacgcaaaagaaggcgcatatcttattgatatgacgacatctaagccttcgcttgcgaagaagattgctgaagcggccaaagaaaaagcattgttcgctttagacgctcctgtttccggtggagacgtcggtgcacaaaacggaacactcgcgattatggtcggtggagaaaaagaagcttttgaagcctgcatgccgattttctctttaatgggagagaatattcagtatcaaggatcggctggaagcggacagcataccaagatgtgcaatcagattgcaattgcagccggtatgatcggtgttgctgaagcgatggcttatgcccaaaaatcaggtctagagccagaaaatgttctgaaaagcatcacaacgggcgcagccggaagctggtcattgtcaaatcttgctccccgtatgctgcaaggcaactttgaaccgggattttatgtgaagcattttattaaggatatgggaattgcactagaggaagcagaattaatgggggaagaaatgccaggcttgtcgctcgcaaaatccttatatgacaagctagctgctcaaggtgaagaaaacagcggaacacagagtatatataagctttgggtgaaataaaaaaagattgcctgtacgaaacaggcaatctttttttattattttccgatgaattgttgtgtccagatgcttccagactcaacgtagccaacaccgatgtgagtaaagttagggtttagaatgttttttctgtgtccttcactgttcatccaagcttttactacttcttctggtgtcttttggcccttcgcaatgttttcacctgctgttttgtagctgattccgaaagatttcatcatatcaaacggtgagccgtatgttgggctttggtgatcaaagtagtttttgtccttcatatcctgagattttgctcgtgcagatttgcttaacgtttcatcaatttgaagcggctttaatccttgtttttgtctttctgcatttgtaagttcaacaacttttttctcgtatgcacttacagatgaaggtgcagatgttgttgtgtttgttttttcagcagttgcgggtgctttagaagcagtgttttgatcagcagctgctttttcagtagtcttttgtgcaggtttggccgtttctgtcttttgaacatcctgaactttcacgttagattgcttcgcatgtttttgaagaaactgcttaatctctttttcgtttgcagcgtttaacgttttgatatttgtgttaatatgcagttttttcactgcatcgttaagtgacatgttttgtactgtgttccccgtttttactgtaaccacaggctggcaggagagttctttcgctgatgcttgctgtacgcccccgaatgtgaataatccaaccgcagcggcagcagataaaataaatgctttcttcattagttcgtaacctcctagagttgtttgtttctacagaaaaatcataacatagcttttttgtcataaagattccagcactttcctttgacaaataaagattgtcattttcgtaaagtaaatccgttgaatcactaagaataagggaatcagcggtatatatgattttatcgtaccgttacatagcttccttttttttgaaccgttagttatattttaatgtgtttttatattgacagctttttttactccttttcgctgtaacaactattacaaagatgttacaattaatctcagtatatgtaaatatattgaatgatttgagaggggtaaccagaagtgactgaaataggacgtgaaccaaagaaaaagagcaaaggaaacagagcaatcagaatgaacctttttttcctagctgtctttgttctattcactgcattaatttttaagctcggggttgttcaaattgttgaaggcgaacagcatgaagaagacgctgagaaatcaaatgcaaaaacagcttactatcctgcgcctcgcgggaagatgtacgacagaaatcagaaagttgctgtcgacaaccagagcgttccagaaattgtgtatgtatcaacatctagcacaaaaacagaagataaaatcaaaacagcgaagcggcttgcttctttcattcatattgataccgaatttttgaaggaaagggatcttcgtgattactggatcgcagctcatccgaaaaaagccgccgctctgcttaaggaatcagaaagcaatctgaaaggagaccaggcttacaagcttcaaatagagcgtgttccggatcaagaattaaaggctattcagcaagatgacgaagaaatggaaactgctgcgatatatacaaggttttcaagcggaaatgcttacgaacctcaaatcgtaaaggcaatgaatccaaataagagcaatagcaatggaaaaaacggagcgctgcttgatgagaagaaaaactcctcgcaaagaccaaaaaatgacttaacatatgatgaaatttccattgtttctgagcatttagaagaacttccgggaatcgatatcgtaaacgattggacacgaaaatatccttatgacaaaaccctttattctgttttcgggggcgtcacgacacctgatcagggcctgctgagcgaccggaaagatttctacttaacaagaggctatgcgaataatgacagggtgggaaaaagttatttagagtatcaatatgaagaatatttaaattcgcataaagaaaaagtggaatacgtagaagataataaaggaaatgtcgtcagccaaaaaaccattgataaaggcagcaggggatacgatcttcagctttcttttgacatggagcttcaggcaaaggtagaaaagatcattgaagaagaagtaagaaacagccgtgcacgcggaaattacatgcttgacagagcctttgtcgtgatgatggacccgaataacggcgatattttatcgatggcagggaaaaagatagatttaaaaaccaacaaaattgaagattatgcgataggggcatttaccacccaatatgaaatgggatcagcagtaaagggggccaccgtgctagccggctatcaggacgggatcccgcattataaatattttgttgatacacctctttatttagcaggatacggtaacaaaccgaagaaatcctacatgaacatgggaaccatcaatgaattaaccgctctgcaaaaaagttcaaacgtatatatgtttaatgttgccatgcacattgccggtgtcacatacaagccgtatggacctcttcctgctgaccagaaggatttaaacaaaatgagaaattactacagccaatttggcctgggagtaaagacaggtatcgatctgccgcaggaatcagccggtatgcaaactacacctgatgcggtaggggggttaattttagacttggccattggacaatacgatacatatacaccgcttcaaatggcacagtacatctcatcaattgccaatgggggctaccgtgttcagccaagaattgttacaagtatccatgagcccagcaaaaaagaaggccttgggaagaccattgaacaaagaaagccaaaattctcaacaaaattaacaactcagaaagtgacattcagcaggtgaagaccggaatgaagctagttaccacctcagggacagctaaaaatacgtttacagaagatgtatcagggaaaacgggaacagcggaaacattttactacggcacgaatcgcaactggtgggggaaaaaaacatacaatctgacttttgtcggctattacccatcgaaaaatccaaaagtggcttttagtgttgttgttccatcagtaaatgatgatgataagatcaataaaattattgccaaaagagctatccacgcctacgcagagctcgaaaaaaaacacagtaaaaaataaaaaacagggtgcacaactaaaagattgtgtgccctttcttttattcaaaaattgacgttcaccataagaatagaaggagaatactcattttctagcgaatcatactaggtaaaagtcaatctgtatatgtcgaaacacgatgatcatgcaaaggagggattctgtggaacaggatacgcagcatgttaaaccacttcaaacaaaaaccgatattcatgcagtcttggcctctaatggacgcatcatttatatatctgccaactccaaactgcatttgggctatctccaaggagagatgatcggatcattcctcaaaacgtttctgcatgaggaagaccaatttttggttgaaagctatttttataatgaacatcatctgatgccgtgcacctttcgttttattaaaaaagatcatacgattgtgtgggtggaggctgcggtagaaattgttacgacaagagctgagcggacagaacgggaaatcattttgaaaatgaaggttcttgaagaagaaacaggccatcaatccctaaactgcgaaaaacatgaaatcgaacctgcaagcccggaatcgactacatatataacggatgattatgaacggttggttgaaaatctcccgagtccgctatgcatcagtgtcaaaggcaagatcgtctatgtaaacagcgcgatgctctcaatgctgggagcaaaaagcaaggatgctattattggtaaatggtcctatgaatttattgaagaagaatatcatgatatcgtgaaaaacaggattatacgaatgcaaaaaggaatggaagtcggaatgattgaacagacgtggaaaaggcttgatggcacacctgttcatttagaagtgaaagcatccccgaccgtctacaaaaaccagcaggctgagctgctgctgctgatcgatatctcttcaaggaaaaaattccaaaccatcctgcaaaaaagccgtgaacgatatcagctgctgattcaaaattccattgataccattgcggtgattcacaatggaaaatgggtgtttatgaatgaatcgggaatttccctgtttgaagcggctacatatgaggatttaattggcaaaaacatatacgatcagctgcatccttgcgatcacgaggatgtaaaagagagaatccaaaacatcgccgagcaaaaaacagaatctgaaattgtcaagcaatcctggttcacctttcagaacagggtcatctatacggagatggtctgcattccgacgaccttttttggtgaagcggccgtccaggtcattcttcgggatatctcagagagaaaacaaacagaagaattgatgctgaaatcggaaaaattatcaatcgcagggcagctcgcggcgggaatcgcccatgagatccgcaaccctcttacagcgatcaaaggatttttacagctgatgaaaccgacaatggaaggcaacgaacattactttgatattgtgttttctgaactcagccgtatcgaattaatactcagtgaattgctcatgctggcgaaacctcagcaaaatgctgtcaaagaatatttgaacttgaaaaaattaattggtgaggtttcagccctgttagaaacgcaggcgaatttaaatggcatttttatcagaacaagttatgaaaaagacagcatttatataaacggggatcaaaaccaattaaagcaggtattcattaatttaatcaaaaatgcagttgaatcaatgcctgatgggggaacagtagacattatcataaccgaagatgagcattctgttcatgttactgtcaaagacgaaggggaaggtatacctgaaaaggtactaaaccggattggagagccatttttaacaacaaaagaaaaaggtacggggcttggattaatggtgacatttaatatcattgaaaaccatcagggagttatacatgtggacagccatcctgaaaaaggcacagcgtttaaaatttcatttccaaaaaataaaacaacggcttaaacgccgttgtttatcgtctgcattgcttcacgtttttttaatacaaataattctaaacggtccaggccttctctcagcgtgtccattgagcatgcaaaagacagccttacatatccttcaccatatgttgagaatgagctgcccggcacgagtgccacaccagcgtcttccaaaagagccatactaaaatcaaatgaagtcattccaaatgatttaatagaagggaagatataaaacgcaccggacggtttaactacgtcaagtcccatggaaacaagacggtcataaacatagtcgagacgttttttgtattgttctctcataatcaatgcatcgtcaaagccgtttgtgacagcttcaagcgcggctttttgagaaatggatgaggcgcacgatacattgtattgatgaacctttaaaatgtgctttgcaatgtctttcggtgcaaataaaaatccaattctccaaccggtcatgctgtgtgattttgacaagccgttaatgacaattgtttgatcccgcaaatggtttgcgatggagtaatgcggtctgtcatatgttaattcactgtatatttcatcggacaatacgaagacatttctgccttttaaaagggctgcaatgcttttcagttcttcttcagataaagtcacgccggtaggatttgacggataaggaagcacgacacacttggtgttgggtgtcagagcgtcttcaatcagccgggcggtaagcttaaagccgtgtgacgtagtatcaacaatgacaggcttggccccgcacaaattgataataggttcatagcctggataaataggccctggcataatgacttcatcaccgggagataaaatcgtccggaatgcagcatcaatggcttggcttgcgcctgttgtgatgataatttcagattcagcatcatagttgaaatccgcttttttcttcatataaagctgcacagcttgtctcagctccaggtagccggcattcggagtatatgacgtcacgttttcatcaatggctttttttgcggcagctttcacatgatgcggtgtgaaaaaatcaggctggccgattgtaagtgaaatgacgtcttcgtgttgggctacaagattcgagaatctgcgtattcctgaaatttcgatctctcttgctttcggattcagcaaatgttccataattcatcaccttaacaaatataatgagtttatcctattttaccactagctgatcatttgtcacctttttaactgatatatttcgattgtatgcgccttttttctaaacatacctttcttttcagaaaaaaagaagacaaccagcgatttgattgtctttattgtatcatgttctattattgtttatatgtgccaatttcattaatagccataatcaaaatgaaggtcttcgtgccaaatcagatacggaggatgctcttcttgaaggtcagctgattctttcttcatattcaggtaagtttcttcactgatatcctctaaaacagtcatttcgttttctttaaatattactaaggtacccattatttacacccttctttggaaaaatccttgactattttatcactgttagttggaaagtcaatggttattaggaaaaaagtttcttttttgaggaacacggcttgttgccttcggaattcgattttgaagagctgccattcactttttacaaattacgccgatatatacagtacaatactgaatgcgaatagcgagggattgaattgtcgttacaacaatacgaaattttattggattctggtacaaatgaattagaaattgtgaagtttggcgtgggtgaaaatgctttcggaattaacgtcatgaaggtaagagaaattattcagcctgtcgaggtgacatcagtgcctcactcccatcagcatgtagaaggaatgattaaactcagaggagaaatcctccctgtgatcagtctcttctcattttttggagtagagcctgaaggatcaaaagatgagaaatatatcgtgactgaatttaataaacggaaaattgtttttcatgtcggctctgtttctcaaattcacagagtatcctgggaagcgattgaaaagccgacatcgttaaatcaaggaatggagcggcaccttaccgggattattaagctcgaagacctgatgatctttttacctgactatgaaaaaattatttatgacattgaatcagattcaggtgttgacacgtataatatgcataccgagggcttcgatgaaagaagaactgataaaaagcttatcattgtagaggactcaccgcttttgatgcgcctcttgcaggatgaattaaaagaagcagggtacaacaatatcgcttcgtttgaaaatggaaaagaggcatatgaatacattatgaaccttgctgaaaacgaaactgatttatcagaacagattgatatgatcatcactgatattgaaatgccaaaaatggacggacacaggctcacaaagctgctgaaggaaaatccgaaaagctcagatgtgccagttatgattttctcatcgttaattacggatgatctgcgtcaccgcggcgaagttgtaggcgcagatgagcaaatcagcaagcctgagatcagtgatttgattaaaaaagtggatacgtatgttattgaataaataaaaacagccgttgccagaaagaggcacggctgtttttattttaaaagtaactctcgccaagttttttaaagaccggtttatggtaagctggctgctggcgatttggcactagcggcttttctttcatgccgacatattcttgcaataggtgtttcgcttttgttaaagacatttgagctttaggatttcggtacgattgattaagtgtacctaaatgcggaagatgttcgaagtcttctttagttggaggcatgtgaaaatagtagtctccgattgagataagcacgtccgattgctgttggctgaaccttggattttttgaaaaatgaagccctattttctttcctttaccttctttgacaagcttttgcaaagcccgttttttcagcagatataggtatttagggttgggggcggtttttgcatggcggttcacagtgtaaactgcttttgaaagattttctacggttggctgcagatctttcgtatatgcatggtcgtccattatttctctcctttgctcttatcaatttctatatgtttagattatacttttttaaagttgaaatgcaaatattgaatgtaaaaatgcgcttttttctaagaaaaaaagcgcatttttaacctgcattatacagatcttgccttctttttcggctgttcttgaaatgcttcctgaacattcacttccacagcctgggcactgtattttggcagtgcaataaaataaaaaataaaaacgatcaggatgataacacccatgccgtaataaagataatcaatgtttgaaacgaacttagggaataacagcgcaactaagccgagtgtcaaagactgtgcaaacatcataaaagggtcctgcatgccgcttacacgccccatcagttttggatgaacaattttgggcatccaccctccgattgcaatgttgatcggtccgatgcacattcccagtgcaaaagctgccgcgtaatacacccataaaatattggtgtagccgaggacgaagatcagcaaacctgcaatgaaaatcggtatcgacattaaaaagtgcggcttcacttttttagagatgatcgtgccgattacgctgcctgccagcagcccaaacccgagtgcgatcgtaaatacagacgtatgccactcataacggtcaggcgccaatccatatttcattgtaaacatcggcaatacggcgaatcctccattgacaaatccaaaaataaaaaagccaaaaataagagatgccagcaatttgttttttaaaatatagaggatgccttctctaaagtcatttattgaatccttaacagaagtctttctccagctgaatgcaccgtttggctgtcgggcttcttttggaatccggcagctgcggatcagcagcccggaaatgataaagctgacaaaatcaagaataatggcgccttcaataccgatggtgttgtacataaacgcgcctataccgactccaaacaccataaaaatgctaaaaagcatctgattaagccctgccgctttcgcataatgctccttcggcagaatggcttgtaccaaactgttttctgccggaaagaaaaactttgttacagcgcttctgataaataagatacaaaaaacaagaggaatattgccggtaaataaagtgaaaaaaagcacgacagtcaggcctgctctgatccaatcacaattttctgccaccttttttctgtcaaaccggtccgcgacgactcccacgatcagaaatacaaatatggtcggaagagaatacatcagctccgccaaggtcgtatatgaaggctggctgctgaatcggtccagcaaaaaaaatgcaaaggccatgttgcctactgtcgtgcccatttgagaagcgagtgctgcgaaaaatagacgaacaaaattacgatttttaaatatatccataaaaacgctccttaccctaaaggtcccactttatcatattataaaccgcctgtttttgaaacaaataagaaaacattaccggttaatcgtgactcttgttccgtttggcacaattgaagcaagttcaatcacgtctttgttatgcatgcgaatgcagcctttagaaacagccttaccaatcgaagcgggattattcgtcccgtgtattccgtagtgctgctttgaaaggctcagccaataagcgccaaatgggccgccgggattgcgctggcggttaataatgtaaaactcgccagtaggcgtttgcgttagtattttaccaacggcgatgggataggttttcattacccgattatttaggaacagcgtaagggtcttcgctccgattgagactgcgatatgatacggaattgtataagggtccggcagtccggggatgactatggactgtcccgctgtgagccctgcctgcagtgacggattagcctggagtaatgcagccgtgctgattctgaaatcagccgcgatgctgttcagtgtatcaccttgcttcacctggtacgtaagcagtttcctcatcctccttttttacttataagtattgatgaggagcccatcctgctacattaatttgtgctttttaaggtgaagacagtgatttcaggcttggccagaaaccgcaaaggcagcctggtcatcccgaggcctcggtttacgtaaatatgagtgctgcccgtttgatacattccctctgtgtagacttttccatatggaggcgtaataatcggtccgtaaaaaggcagctgaatctggccgccgtgtgtatggccggaaagctgaaggttcacgggataatctgttgttttcaaggccgcatcaggttcatggacgagaagaatggaaaaaagtctgtcgctcagccttgaaagggtgccttcataatctgggtttcccagcattaagtcatcaagcgaagcaatttcgattttgctgccatctgcgagtgacaatgtttgatagccattgcgatataccgtgaaacctccggccgtcatcaggcttttgtaaacggcagttccatagcctccgtgatcatgattgccgtaaatacaaagcttgccgaagggagcattaagctttctcaataatggaatgactgcctggtggtgctggtacgtatcaggattatcgataatatcacctgtaaaaacaatgagatcaggtttagattcattaattgtaaggatgacagtttttaaatcttcgagagtaaagtaatcactcaagtgtgcatcgctgaactgcacgattttaaaaccgtcaaatccgtgcggaatgagagagctttttattgtgtgttcggttgtctcgatcatatgcggctcgagatacctggcatagccatatcccccgccggccgttaaagccccggcagcaagagcgccgaacattccttttagaaattgtcttctggacatctttttcatttcaaaccaacctttaatagagtttttctattatatcatctgtatctgataaaaatctcatatgagcatgtgctgacagaggcagggatataatgatagaatattattgaatgaatactcattcacaattggagggataaacatggaaaaaaaggcggtaattattaccggcgggtcaagcggcatgggaaaagcgatggcaaaaaaacaggctgaattagggtggcacgttatggtgacagggaggaaccatgaagcacttgaggaaacaaaaaaagaaattcagacctttgagggacaggtcgcatgttttcaaatggatgtccgttccgattccgccgcttcagacatgattaaagaagcgataaaagcctttggccggcttgacgcgctgattaacaacgcggccggaaactttatttgtccggcagaaaagctgacgcccaatggatggaaagccgttattgagattgttttaaacggcacatttttttgcagccaggcagcggcaaggcattggattgaccagaagcagcagggtgtcattttaaatatggcagccacgtacgcttggggagcgggagcgggggtcgttcattccgctgcagccaaagcgggggtattgtcattgacaagaacgctggccgttgaatgggggagcaaatacggcattcgcacaaacgcgatagcccccggaccgattgaacgaacaggcggtgcggagaagctatttgaatcggaaaaagcgatggcccgcacgatgaacagtgtgccgctcggccgattgggcacaccggaggaaatcgccgctttggcagcgtttttgctttctgatgaagcatcctatataaacggggattgtatcacaatggacggggggcaatggctgaatccttatccgttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggtataatcagacaaagatagagaagcaggtgataacatgttggatccacttgatattttaacgaacattgatgatgtccttccatattaccaggcgattttcagtgccgaggaacagaaggttgtcggatatgaggtgcttggacgaattttggcagattcagaaatccaaagtctcgggcccttctttttagatgcggggatacccgaagaatataaactagaggttgataacagaattatccgccaggctctagaccgctttttagaggcggattctgatctgctgatttttatgaatcaggatgccaatctgctgatgctggatcatggtgaaagctttctggagcttctgaaagaatatgaagcgaagggaatcgaactccaccgttttgtgcttgaaattacagagcacaattttgaaggggatattgagcagctctaccatatgcttgcatactatcgtacatacggaattaaaatcgcagttgacaacatcggaaaagaaagcagcaacttggacagaatcgcgctgctctcaccagatctgttaaaaatcgatttgcaggcgctgaaagtgtcacagccgtcaccgtcatatgagcatgtgctgtacagcatatctttattagcaagaaaaatcggtgcggcgctattgtatgaagacattgaggcgaacttccagcttcagtacgcctggagaaacggaggccgttattttcagggctattacttggtgtctccatctgaaacgtttctagagagagatgtattgaaacaaagacttaaaactgaatttcaccaatttatcacacatgagaaaaagaaactggagaccgtctatgagcactctgaacagttttacaaacgagtgcatcaggctgtgacctctttgagaaaaaacaatctgtcttctgatgatgactttattaaaaagctggcggaagagctgacagattgcagcttcaggatttacatgtgtgatgaagaaggcgatcagctgacgggaaatgtgtttaagcaagatggagaatggatttatcagccggaatatgcggaaaagaactggagctggcgcccttattttctggagaacattatgagaatgagaaatctcagaaaaggttttttcagtgatctgtacagtgatttagaaacaggtgaaatgatcagaacgttttcatatccgatggatgatcagatgtatttatttatagacttgccttattcttatttatatgagcaggacggactgatttaacggctgaaaggccgtttttttttatgaattgaaaaaaatatcaaaaaacgattgacattgatactgagaatcattatcatttaattgtagagagaagctactctctgttccccaacccctctatcagatcaagatccgaaaaaacttggcgctacccccgccaagttttttatttgtcaaagcataggacaatccaatgaaacaataaacctaactagtggtaaacgtttaacacggggagaaacattcagtgccgaacacccctgacactgctgcacgggtgaggaggaaaattcgttctgaaatgtttatttcagttccgttgtttacctctatccagcatgactcccattgattatggccacgcgggacttcaccataaaattcaaaagaaggttttgacaaagttgcaaaaaggcattcttaatgctgccaaagattcgaaaaaaattataattgtgtgcatgacattcaaaaaaagcctcaaactaaagaaaaatagtttttttcactttttttctttgcttaaattcagcagtgaaaatgccatcctgtccgactttatggtatgatgctcaatagaacttgtattataataaatacttgttgatttgaagttgctttttgaaaggagtctttttttagaatgtcacaattaatgggtatcatcacacggctgcaaagtctgcaagaaacagcggaagcggctaacgagccaatgcagcgctatttcgaagtgaatggtgagaaaatatgcagtgttaaatatttcgaaaaaaatcaaacgtttgaactgacggttttccaaaagggtgaaaaacctaacacatatccgtttgataatatcgacatggtttccatcgaaatctttgaacttcttcagtaagattcctgaaatagggggaacaagcttccgcctttgcaaaagtaatcgaaataaacggtaaggaacatacttgtttcatggttgtaaatccttgaaaaggagtgtcgtgatggctgattcttttctgttttataatctttcagaagcacagatgacctttcaagatgtgatggaacggcttaaagcctttgttcaaaaggacccccgttcttcttatgtgttatcgatcggaaccgattcacaggtttaccgcgattacacaaagtttattaccgcattgcatttgcatcgtacaggcaagggagcttggggctgcttgaaaaatcatacagtcgacagacccatacatagccttcgggagaagatttcgttagaaacggcgtacagccaagaaacggccgctcatattcttgatggacacttaatggatattaccgatctgctcctgccctttaccggtgagggggcggatcttacctttgaagttcacttggatattgggaaaaaagggcttacaaaagatctgatccaggaaatgactggacgtattacctccatggggattgaggccaaaataaagccggattcatacactgccttcagctatgcaaatcgtttcacaaaataatttggctgaaaaagccaaggtaaatgtcgaattatgcggttgacgtttgttatctgattacttattctagcggtagagctgaaagtaagttgtcttgctttcagaggtattcagtataaaacagggggcctgattgcgaatgagtcttatcggtgaacgatttacagaagaagaacaaaaacttctgctgaatatcctgatcaaccatgagtatgccatcgagctattaagcagtgagatcaacgatatagagacaaggaccaaaaacgttgacggaaccacctacaaaaaacttgtaacgctatacgaccgatttcgatttgaaaattaatgggacaccctataattgatactccacaaagagtatcttttttattgaaaggaaacttttcgacaaatactgataaagtttatattattgcaatatagggaatgtattgatgatgaaaatgaaaaggggtcgaaaacatgataagcttacaatcagatcaacttcttgaggcaacagtcggacaatttatgattgaggcggacaaagtagcgcacgtgcaagtcggaaataaccttgagcacgcattattagtattgacaaaaaccggatacacagccatcccggttctggatccttcctaccgtttacatggcttaatcgggacaaatatgatcatgaacagtatttttggacttgagcgaattgagtttgaaaagcttgaccaaatcactgttgaggaagtcatgctgaccgacattccgcgccttcatatcaatgatccgattatgaagggattcggcatggtcattaataacggatttgtctgtgttgaaaatgacgagcaggtatttgaagggatttttacgagaagagtcgttttaaaggaattgaataagcatatacgctcgttgaataagtaggctgtacggcctatttttattatatagcagagcaaaaaaaagaaagcgcatacataatttaaacgagaatagggcttgaataagaaactaagattttattagaatgggagataagaaaaacttattgctaacaaaaaggaggacgacatgcagcttcaagagcttcatatgctcgtagttttagctgaggaattaaatatgagaaaggcggcagaacggctttttgtatctcagccggctttatctcagcgcttacaaaccattgaaaaggcgtggggaacaaaaatctttttaagatcccaaaaaggattaacggtaacgcccgccggtgagaaaatcattcagtttgcgaatgatgtgacattagagcaggaaagaataagagaaaatattgacgagcttgaaggtgaaattcacggcacattgaagcttgccgtcgcctccataatcggtcagcattggctccctaaagtcctgaagacgtatgtggaaaagtatccgaatgcaaagatctcgctcataaccgggtggagcagcgaaatgctgaaaagcttgtatgaggatcaggttcatatcggcattataagaggcaaccctgagtggaaggggcgcaaagattacttaatgacagatcatctgtatttagtggatactgaaatttcctgcatcgaagatattgcccatacagaacggccgtttatccagtttaaaagtgacagcacttattttcaggaaattcagcactggtggcatcaaaaatttaaaacgtcgccgaaacagacgatattggttgatcagattgaaacgtgcaaacagatggcgctgcacggaatcggttatgctattttgccgtctgttacccttcaaaatgaagataaagtgaataaaatgcctcttttggacatgaaagggcatccgatcggtcgggatacatggttattaggctatgagcctgcctttgaactgaaacaagttcaagcttttgtacaagtgataaaggatatgctggatcaggaaaatccattttaaagacagcgaggtgctgtctttttttatttatctgttgacaatgaaaatcattatcatttaaagtgatacatatgatattgaaaatcattatcaattaatggggtgataacatggctaaagccttgattacatatgccagcatgtcaggaaatacagaagacattgccttcataataaaagatacgcttcaggaatatgagttggatatcgattgtgttgagatagatgatgtggatgcgtcttgtttaacctcctatgattatgtactgattggcacctatacatggggggacggcgatttgccctacgaagcggaggattttttcgaagaggtcaaacagcttcagcttaatggtttaaaaacagcctgcttcgggtctggcgattattcttatccaaagttttgcgaagcggtgaatttgttcaatgtcatgctgcaagaggcgggagctgctgtttaccaggaaacactaaaaattgaattagcgcctgaaacagatgaagatgtggaaagctgccgagcgtttgcgagaggttttcttgcatgggcagattatatgaacaaggaaaaaagccatgtttcataaaggagcaactgctgttacggcatcggcgttttctggatattttgtggcggtacaaagagaaggcatttttcattattctttggagcagggctggagaaagctttttcgtttgaaaagtaagatacactgtatcagctacatagggccttacttatttggcgttggtgaaaagggaacagtcattcgttcggctgatgaagggaaaacctggacgatgtcgagctttccgacaaatgcaacagtgtgggcgattaccggcagaaacaacgggtttgtctgcgcccacggtaagcattgtatttatgtatcggatgattttggtgtctcatggcgcgtagccaaaccttttgccgaatttcataatccccctgttatccggtcgctatgccttcacgggggcaatctttttatcggcacgcaaatacacgaatattttggcggcatttgggcttacgacattaagcgtgacactgtccaagttgtcaaaaaagaaaaaaaccggatgacggcatccatgctcgtgttcaatgaaaattggctggtggcggcgatgggttctgtgaaaggaaagcacggtgctgtcaccgtacggaatcttttgaatggtgaagaattcatcattcaatccagcatgatcagaatagaagaatcatttcttgatctttcagaggatgatggcattatatatgtcactacaacacaagatgaaaacggtttttcgagaatttaccaggctgatctcgaagcccgatcgttaaaatggttcgataccattaaggggcatggatggagagtggccaatcagaaagagaatttcttttgcgcaggcttgtatgaatgtaaatttgtccagccgtacgaagtttcagcaatgattcattagaggaggaacaaggaattggctaagattttgcttgtttatgcaacaatgtcaggcaacactgaagcaatggcagatttaattgaaaaggggcttcaggaggcggaagcagaagtagaccgtttcgaagcaatggatattgatgatgcccagctgtttaccgattatgaccatgtcataatgggaacctacacgtggggagacggagatctgcctgatgaatttttagatcttgttgaagacatggaggagattgatttttccggtaaaacatgcgctgtattcggttctggtgatacagcatatgaatttttctgcggagcggttgatacgctcgaatcaaaaataaaagaatgcggtggcgacattgtgctgccttcggtaaaaatcgaaaataatccagaaggtgacgaagaggaagaattaataaactttgggagacaattcgcaaagaaaagcggatgcgctgtctgatcactcactgggaactgctaaaacggctgttcctttttttcttgtctttgtatctttcctttgatacagtaatgaggtagaaaatcaggaggaggactatacatatgaaaatgatggacgcaaatgaaattatttcatttattcaaaatagtacaaaatcaacacctgtaaaggtttacgtgaaaggtgagctggaaggaatcaatttcggcgaatctgcgaaagcttttatcaacggaaacactggtgtcgttttcggtgagtggagcgaaatccaaacagcaatcgaagaaaaccaaagcaaaatcgaagactatgtggttgaaaatgaccgccgcaattctgcgatcccaatgcttgatcttaaaaacatcaaagcgcgtatcgagccgggcgcgatcatccgcgaccaagttgaaatcggtgataacgcagtcatcatgatgggtgcttctattaatatcggttcagtcatcggcgaaggcacaatgattgatatgaacgttgtgcttggcggacgagctactgtcgggaaaaactgccatatcggcgcgggttctgtacttgcgggcgttattgagccgccatccgctaaaccggttgtaattgaagacgacgtcgtaatcggcgcaaatgctgttgtgcttgaaggtgtaacagtaggtaaaggagctgttgttgctgcgggagcgatcgtggtaaacgacgttgagccatacactgtcgttgcaggcacaccagctaaaaaaatcaaagacattgatgaaaaaacaaaaggcaaaactgaaatcaagcaggaattacgccagctgtaaggaaaagtttgataaaaaaggcgtggataatatatccacgccttattcgtataggcaggaggaatagaaatgaagaaagaggagctcatcgcaattcgcagagatctgcatcgtataccggagcttggatttcaggagttcaaaacccagcagtatttattacatgtcttggaacaatatccgcaagacagaattgaaattgagaaatggcgaacagggctttttgtaaaagtgaacgggacggcgccggaaaaaatgctggcgtacagagcggatatcgatgcgctttctatagaagagcaaactggtcttccattcgcatcagagcatcacggcaacatgcacgcctgcggtcacgatttgcatatgacgattgcactcggcattattgatcattttgttcaccacccagtcaaacatgatttgctttttctctttcagccggcagaggaagggcctggcggtgcggaaccaatgcttgagagcgatgtattaaaaaagtggcagcctgatttcatcactgcgcttcatattgctccagagcttccggtaggcaccattgcgacaaaaagcggccttctatttgcgaatacatcagagctagtcatcgatctggaaggcagagggggacatgcggcatatccgcatttggctgaggatatggttgtagcggcaagtacacttgtcactcagctgcaaacgattatctctagaaacacagatccgctagacagtgctgttattacagttggtaccattaccggaggctcggcacaaaatatcattgcggaaacggcccacctggaaggcacaatccgcacgctttctgaagaatcgatgaaacaggtaaaggaacggattgaagatgtggtgaaaggaatcgaaatcggattccgctgcaaaggaaaagtgacatatccgtctgtctatcaccaagtttacaatacgagcggattaacagaagaatttatgtcttttgttgctgaacatcaactggcgactgtaattgaagcaaaagaagcaatgactggggaggattttggctatatgctgaaaaaatatcccggcttcatgttctggctcggcgctgattctgaacatgggcttcatcatgctaagctgaatcccgatgaaaatgcgatagaaacagcggttaatgtcatgacaggttatttttctgtttatgccaattaagtacaaatgaaagaataaaattccataaaatgagcactctagtaaacggaggtgttcaaaaatggctaaaaaaataggaattgaacaatcattatcagatgtagaagctgctttaaaagaaaaaggatatgacgttgtaatgatgaaaagccctgctgatgctcaaggctgtgactgctgtgtcgtaacaggtcttgataataatgtgcaagggatagccgatacggtaacacaagcacctgtcattacagcttccgggatgacggctgaagaaatttgcagcgaagttgaaagcagaattcagtaatataaaaaccgaagcaaaaagcttcggttcttttatttattctgtttctttagggaaagcgcggtcgaacgcgttctttatttcttttctcaacactcgttcgactcgccactgttccatattttctgttttggcaatgaccctgatcacaatttcagaagtccccagttcttgaatcccgatgacatttgggccttcttttatttgtggaagagccgctgccgtctcatcacaaacctgctgtaaaatatgaatcatttcatcaatgtttctttcagccggcactttaatatcaacaagagcctgcatggtaccacgagaatgattactcacgtttgtgatgtttctgttggggatgtaatgcaatgttccgtcaaagctgcggatttgagttgttcttaagccaacctgctcgacaattccgtcaaaggtggaaacggtaatatagtctccgacatccaattgtttctcaagcaaaataaaaaaacctgtcacgatgtcactgacaagcccttgggcgccaaatccgacagccaggccgacgattcctgcccccgctaaaagagcgcttggatcataatgaaacaaatctagaaccatgacgaagaatataaaaatcaaagtataagcaaatatgttaagagtcaggcttcggagcgtatgtgcacgtccgatagacaagctattctgctcctcgaattttgcaaacagatgtttaatgattttcatgcctaatgatcgaacgataaaatagagcaatatcataatggcgagtttaatgagcagaacaccggcatttgtaatcagtcccgcccaatcatattgtttaataaagtccatgttgagctccttttctaattgattgctgcacattgagactagttaccctgtacatgaccatgttaaacgttttattcaaaaatgtcgaagccaaagacatacatgatttgttaaaaattgactcaggaaatctgcttttatataatggcattgcaatataactaaaaatggttaatcaccctttattttcatgcgattttgacctttaagccaaacaataaattggagggatacatatggcagaacgtatggtaggtaaacaagctcctcgttttgaaatggaagcagtccttgcaagcaaagaattcggcaaagtaagtcttgaggaaaacatgaaaaacgacaaatggacagtgctattcttctatccaatggatttcacttttgtttgtcccacagaaattacagcaatgtctgaccgctatgacgagttcgaagatcttgatgcagaagtcatcggggtttcaactgataccatccatactcatttagcttggatcaatacagaccgcaaagaaaacggtcttggccagctgaaatacccgcttgctgctgatacaaaccatgaggtatcccgggaatatggcgttttaatcgaagaagaaggtgtggctttgcgcggattgtttattattaatcctgaaggggagcttcaatatcaaactgttttccataacaatattgggcgtgatgttgatgaaacgcttcgtgttctccaggcgctgcaaactggcggactctgtccggctaactggaaaccaggccaaaaaacactttaattctttccaagaacgaaaagcggtctagcatattcgttaggccactctgttaaataggagggaaaagcaatgaaattacgtcagcccatgccggaattgacgggagaaaaagcttggttaaatggtgaagtgacgagagagcaattgattggggaaaagccgacgcttattcatttctggtccatcagctgccacttgtgcaaagaagcgatgccgcaagtgaatgaatttcgtgataaatatcaagatcagctgaatgttgtagctgtacacatgccccgttccgaagatgatcttgaccttggtaaaattaaagaaacagctgctgaacacgatatcactcagccgatttttgttgacagtgaccatgctttaaccgatgcatttgaaaatgaatatgtacctgcatattatgtgtttgataaaacaggacagctccgtcacttccaagccggcgggagcggtatgaaaatgcttgaaaaacgtgtgaaccgcgttctggctgaaacggaataggtatctgactaaatagtatttcctaaaaacctgatcacatccggttttttatttgtgcaaaaagcaatggaagaagagtaagaagcttatttttccaaatttgggtataggaattgatggtttgtttgattgatacgctagaaaacacagctaatttttgatgtttttcctcaattttagataaatctcatatctcataactcgaaaattgtagatattacactaaatttctttaaagaagtaagtaaaatatatattttcaacattataccaaataaactagaaagccccttaatcccttgagaataaaggactcttttgaaaaataaaacattttcagaaaataaggaatttttcatagagtaaatataatagtaaaatgctaaaataatagttgataaaattacttttgtaatctaatatcttaattaaagatgttaattttgatagggggtacattgaggaatgtttaatgaaagagaagctttgcgcttgcggttagaacaattaaatgaagctgaagtgaaagtcattcgtgaatatcaaattgaacgtgataaaatatacgcaaaattaagagagctggacagaaatggaagcccttccgaaatcaaaaaggatttccgttctgaaaaaaaacctgactctctgccggttctcgctgagcttgcggctcaggaaatcagaagctatcagccgcaatcacagcagcagtctgttcagcctcagcttcaatctatttcctctcttcctgccggtataccagacggaacaacacgaagaagaagaggaacggcaagaccgggatcaaaagcagctaagctgcgtgaagctgctattaaaacattaaaacgccacaacgcggcgattaagagctcggagcttcaaaaagagattgaaaaagaaagcggtcttgaaatccctaatatgacaacatttatgcaaagcttaattaaaatgtacccggaagtgaaaaagccatatcgcgggcagtacattttagagggtgaaatcgaatctgcagaatcagcaaatgaataaatataaagaaaaactgcttggcatcgctcaagcagtttttttattgaggttttttctgtgaaggtttgttttctttttcaagattaagcttatacacccacttttgataaggcttttcttcagcggctctgtttttcagctcttcgattgtatggctcttggcctggtctgatgattgggcgcgggcaagctgtttttgaagcacatgtatctgtttggtgacatcttcaaggatagtctctacatgatttggctgcgcgtagaccgctggagcttcttcttccgttttttctttttgtttcgtgccgccatcaatatcggcaaaatgagaagcaatccaggcatcgttttcatcaagctgccgtttatacgatataatagtttcgtgaaataatttttctttcgttttttctatgtctagcagtctttctttcgtttctatgattcgatctttcatatgatcaacttctattttaatatgttttagctgatattctttttctaccatttgctcttttagacgcccattttcggcttttatcaattcggcttgctgttttgcctgaagcagtgcattttgttcctgctcaattgaggcttgaagttcgctgatccgtttatgaagatttttattttcttcttcgattttgactttagcaatatgaagtttatgtttttcttcgatttcggctctgcgtttataggtttcagcagatagaagctcctgcaaaacaacgattttatcaagcagttcagctcttatttggtgcagggtttggctggtgtgggaggcatgtttttcttttgttgacatatgtgttaattcggcagacagctgctggagtttttctttcatatcagtattttctttgagcagtttgttatttttctgatgaaagtagcttgcttcaagttcagaaatcagcttatggcaccttgaaagctcggattttaaataaaggttctcctgagacacgtcgtggaaaaaaggacctgatcttttcattcgaaccatctccctcatgatgttaacactacaatatgcaaatactgaacagctattcctctttaataaacagacaagcagtagcgttgagcctttgcttttgctatgcttttaacgaaactagaggtgagatgatatgaagcatgtaaacgtactgctggcagggggagcctcacgtcgctttggagaaccgaaggcgtttgtcaaatggaagggtaggatgctttacgaatgcgctaaagaggcacttggagaacaaacggttatcatcagccgtcccgaattaattgatagatttcaagaaaacggtgaaaatgaagtgtatcaagatgctgagccatttcaaggcatggggccattggctggtatatataccgcttttaaaaagacagacggtgatctttgtactgttctttcctgtgacacaccgctgatacaaagaaggacgatgctggagctcaaacgtctgatgactgtcggtgcggacgcggtagtcccaatttcagacggacaagtgcagccattgattgcgatttaccacaaacgtatcatgccagttctatacgatcagctttctgagaagaggttgagaatatcagatttattaggcagaatttcggtttgttacgtacaggctgaaaatatcggagcaaacccggcagagtttatcaacattaatacacgtgatgattttagctgtttggaagaaaaatcgaactccctcaagcgggactgacggggcaataacatgataagatgacataaaagataaggagaacaggtttgatggaggaacgttattcacggcaaatcagatttaagcaaattggggaagagggccagaaaagactggcagacagccatgtgctgattgtcggagcgggagcgctcggcactgcaggagctgaaggactttcgagagcgggagtcggtacgattaccattattgaccgtgactatgtggagtggagcaatcttcagaggcagcagctttatacagaaagcgatgccaaactccgcatgccgaaagccatggctgccaaagagcatctatcagcgattaacagcgagatacatattgaggcgtatgttaccgaaggaacagccgaaacgcttgagcctctgattgaaaaagcagatgtcgtgatcgacgcgacagataattttgaaacccgcatgctgataaacgatcttgcccagaaaacaaagacaccttgggtctatggcgcctgtgtaagcagccagggaatgttcatgactgtcattcccggagaaaccccttgtctgtcttgtttgtttgagcaaattcctgtcggcggggcgacgtgtgatactgccggcattattccgcctgctgtgcatatcgtttcagcatatcagcaggctgaggcattaaagctgttaaccggccaaatagaagcaatacagcggggttttgtgacatttgatgtctggaacaattcgcatatgaagattaacgttaatcatgtacgccgtgaggaatgcccatcttgcggagcaaatgcggtatatccttatcttcaggattggaacacaccaaaagctgctgtactatgcggccgtgatacagtgcaggtaaggtcagaatcattaaaaagaatcccgaaacaggaactcattaagcggctgaaaacaatcggcaaggtcgaggctaatgcgtttttgctgcatattttttacgaggatttcagaattgtcattttcaatgacggacgggcactggtgcatggaacaaatgatgtgaaagaagccaactccgtgttggcaagagtgattggactgtaacaacaggaggggtcagaatgctggagaaaagaacaccgataccggtagacgaggcagttcggcgtgtctgccattttcaaaaacaaggtgaaacagaatgggtggcgcttgaagacagccttcatcggtttttagccgaagatataactgcggatcaccacgtccctgcgtttgaccgttcgccatacgatggttttgctgtcagagcatgcgatacggcagaagcttcacgtgaaaacccagttcggtttgaagttattgaccatattggagcgggagcagtatctgaaaaaaaacttggcccgtttcaggccgtgcggattatgactggcgcgcaaatccctgaaggggcagatgcagtcgtcatgattgaactgactcaaacctttgaggagaatgggaagtcatttatgtctttaaaacgccgctttcagacgggggataatatttcaaaaacaggtgaggacgctcaaaaagggagtgttttactgagaaagggcacccgggtgacaccaggagtgacggctcttttggcaacattcggatacgcatctgtgcctgtcgtgagaaagcctgtagtcgggattatcgcaaccggtaccgaattgctgaatgtcagtgatccgctggaaccgggaaaaatccgcaacagcaatgcgagtatggtatatgcgcaagcgatagaagcaggcgcaacaccgctttatttagggaaaatctctgatgatctggataaaagctttgctgcagttaaagaagcgatgaaaaaggtggatttcctgatcacaactggcggtgtgtcagtcggtgactttgactttttgcctgcgatctatgaaaaactcggagcggacgtgctgtttaataaagttgccatgcgcccgggcagcgtgacaacggtggcgcatgcaaacgatatgctgctgtttggcctttcaggtaatccgtcggcatgctatgtcggttttgaactgtttgtcaaaccgataatccagacatggctgctcaatgaaacaccgcattcaatttgtgcggaagcagttttgaccaaggattttccgaagccgaacccatttacccgatttgttcgtgcgctcgtgcaccatcaggaagggaagctgttggcgacacccgttggtttagataagtcgagctctgtcacatcacttgcagatgccaatgcatttattatcctgccgggcggcacgcgaggctacgaatctggcagaacggttcaagtactgctcatcagagaagagaatggaagtgaatggccttggtccgtcctttcccgatcgtccaagttgtaggatttcaaaacagcgggaaaacaacgtttattgagcgcattcttgaaaaagcctctgaacagggagtccatttgggctgcctgaagcatcatggtcacggcggtgaaccgcaaacgctcacggaaggaaaagacacggaccgttacaaggcggcaggtgctggtgtaacagcggtagaaggtgctggtgtgttacagctgactgcccgccgcaattgggatttggcacggctgatcgagttataccaatttctcgaaacagactgtcttctgattgaaggctttaaaaaagccccttatcctaaagtggttatcctaagtgaaaaggaagatctggaagcgctgcaagcagtaaatataatcgccgtcatctatagaaaaaaagagcaaatgacagagcatcagggattacccgtttttcatgcggatgatccggttgccgtggattttgtgctttcacagctgaagggggaatctgcataatggaacggtttgagattacgaaaacacccattaatactgaagacatgatcaaaaaagtggagaaacgggaagcaggggccattacgacatttattggtacggttcgggaatggacaaacggaaaaagaacggttcggcttgaatatgaggcatatgaaccgatggccgtgcaaatgcttgctcaaatcggcgctgaaatcgaagaaaaatgggaaggtgcctcagctgcgatcacgcaccgtataggtgtgctcgatatcggtgaagcagcggtagtgattgctgtatcttctccccatcgaaaagccgcatatgaagccaatgagtatgcgattgaacgcattaaacagattgtgccgatttggaaaaaagaaatttgggaagacggtgagcaatggatcggcgaccagctagaaacaacagcttatccgaacggaaaaccagacctaagcgagggagagcagcatgattaaaattcttttatttgcaggactggctgaacaggccggtacacaagcaatagaaatagatgtggaacaagcaaccacagatgaaataaaagcgagtctaaaagaacaatacggtcttgaatctattgatacggctatgattgccgttaacgaaagctatgtaaaagaaaatacctctgtatcttcgggtgacacggtagccatcataccgccggtcagcgggggatgaaaaccggacggcatttcagccgtccggtttttctgtatttcattggcatatccccaagtatcctcagcatacaatgattttctgtaagcgtttattctacatatgttactccctataaagtaagagactcactccataattagactgaaattttgaaaaataatagaaatttatttcgggtatcgatatagtgaagatgataaatgttggaaaggtgctggatatggagacatttaaaagattaaaaatgtattattggccgtacagaaaagtgtttatgtggtcgcttctagccatgcttttgatgactgcaattactgtcgtttatccgattatcctgcaaattacgattgatgagatcgtgcttggaaggcagtatcagcttgcggcgtgggtcagcttaggatttattgcggtaatggttttgaaaggaacggctaccttttttcatcagtatttaggtgatatgttcgggatcaaatccgtttatcggctgagaaatggtctgtatgaaaaactgcagcggctttctttttcttactatgataacgcgaaaacaggagatttgatgtccaggctgactgctgatgttgaagggcttcgttttttcttatcgtacggtctcgctgagctcattcgcttcggcctgctggtagccatcagcctgtcggttatgttttactattctgttcctctcacgcttgtgacaatagctgttctgccatttctcgcggttgcggtataccggtttgacaaaagagtccatcccgccttcagaggcatccgcaaatcgtttgcgaaactcaatacaaaagttcaggaaaatatcagcggcattaatacggttaaatctctttccagggaagattttcagatcagcactttcaataaagccaatgcagaatacagggcgcagtatttacaaacatcatccatctggtctgcgtatttccctttaatggagttcattggtaacatttgtattgtagctctcctctcatacggcggttacttggttatgcaaaatcagctcaatcccggcgagctcgttgctttcttcagccttgtcaattatatgatgtggcccattatgaacttaggttttgtcatcaatatgttctctcaagcaaaagcgtcaggggaacgcctgctcgacattctggaaaaagaagaagacattacagatcatcctcatgctttgcataaacaaaaattaaccggagatgtccatttcaaaaatgtttctcttgcatacgggaaagaacaaacaaacgcgctgtgcaatgtaagctttgaggcaaacagcgggaaggtaatcggactgttgggcccgacaggttcaggcaaaagctcagtgacacagcttctcaccagattttacagtcctgttggcggaatgattaccattgatcacaaaccaatcacggattattcgttaaaaacccttcgctccaatatcggggtcgtacttcaagaatccttcctgttttcatctacgattagatcaaatatttcgtatgggcggccggatgcctcaatggacgacgtcatcgaagcggcaaaaagggcacaggctcataactttattgtggagcttcctgatgggtatgacaccatgctgggagagaggggaatggggctttccggcgggcagaaacagcgtattgccattgcgagagccatctgcttgaacccgagcattttaatattggatgatgccacaagcgcagtagatatgcaaacggagcacagcatacagcttgccttaaaagaagtcatgaaaaaccgcacaacctttatcgtcgctcaccgcatttcttcactgaaacacgctgatgaaattctcgtttttaataaaggacgcattcgtgaaaggggaacacatcatgagcttcttaaaaaaggcggctactataaaaagatttacgatttgcaataccgtgatgtcaaaatgattaatgagccgcatgaggtcggatagggaggggccaaatgaaacaagcgaaaaaacaggggattttagagcgtttctattactcttcagatgaaatcattgaaaagccgtttaactgggctcaaatgtggcggctgctgagctatgtcaaaccatatcgaaaaacaattttgccgctttcttttctcaccgtattaattggcactgctgtgaagcttgtgatccccattttgatcggcgtttatgttcttgatcaagcgattacagggagaaactcggagctgctgattcagctcatttttattattagcggtttatatgtcctcaattacgccgccaatgtgttaagaatcaggtggatgaatcagcttggccagcatgtcatttacgatttgcgacagcatttatttacccatgtgcagcgcttatcccatcgattttttgatcagcggtcggcgggatcgatcttagtcaggatcatgaatgatattaactctcttcaggagctctttacaagcggagtcatcaatttgttgaccgacttgctgcttctggccggcgtgattatcattttgtttacgctgagccctgagctgactatagccatcatggtgacattgccgattatgttttttatttcaacaagtctcagaaaaaaaatacgccgatcctggcaaacggtacggctgaagcaatcgaagctcaactctcatctaaacgaaagcattcagggcatccgggtcacgcaggcatttacgcaggaagaagaaaacatggcgtattttgacggtgtcaatcaggagaactacgaatcatggcgggaagcaactagaaaaaatgccatgttccgtccgcttgtagaaatgacgaatgcgattgggacggctgtcttgatttggtatggagccacactcatcatgaatgaaaccattacgattggcgtcttcgtttcttttgctttctatctgggaatgttttgggaacctatttcgagactgggtcaggtctataatcagctgttaatggggatggcatcatcagaacggatttttgagtttctggacgaacagccaaatgtcaaggagaagccgaatgccattcaaaatgaaaagataaatggggagatcagttttgaagaggttgaattttcgtatgatgaaaaacgaaaagcccttcacgccgtttctttctctattcctgcgggctcgacgcttgcgcttgtcgggcatacagggagcgggaagacgacgattgccaatttaatcagccgtttttatgatgcgaccggaggcaccattaaaatagacggtataccgattaaggatctttcccttgccagtctgcgctctcaaatcagcattgtcctgcaagatacatttattttctctgggaccatcatggaaaatattcgttttggaaggccaaatgcttcggatgaagaggtgatgaaagcgtcccaagcggtcggagcggatgagtttatttccgatttagcggaaggatacgcaacagaggtggaggaaagaggcagcgtactgtctgccggtcagcgtcagctcatttcatttgcaagagcattgctcgccgatccggctattatcatccttgacgaagcaacggcaagcattgatacagagacagaagtaaaaattcagcaagcgttaaaagcgcttctgaaagggcgtacagcagtgatgatcgctcacagattgtctacgatccgcgacgccgaccgcatcattgttcttgatcacggcaggaaaatagaagaagggaaccatgatcagctgctcgctaaaggaggcatttatgccgggcttgtgaaagcgcaatacagcacagcgatagaataatatgaaaagccttcaatattgaaggtttttggaaatttattagaaaaacatgaaactttttgatatccttcccgtactatttgttagatatctcaaggaggttttgaaatggaaacgaatgtagaaaaaaacagcggaacggcgactgaaaagccttcacttttcggagtaatcacaagtccgtccgttcaatttgaaagaataagagaaaggccggctgtatggggaccgcttttgattgttgcagcaattatcatcgtcggtgccgtgctgcaatcactcggtacggattatagtgagcttttgaaaagccaggatacgcaagggctatctgctgaacaaatggaaactgtcgcaacaataaccaaatttggcggaatggcaggcgctattatcggcggtatcgcagcattatttattgcccctcttatttattggctctgtgtaaaaatatcaggcggagttacgacatataaaaaaatgctttctctcggtctgtttgtctctttaattagcagtctcggattattggttaatggaatcgttgcttttacgactgacgtgaatcctctttacagcacgacgtcactggcagggattatcccatctgacggggctcttgccagcgtgttaaatacctttgaaattttcagcatctggagctttgtattattagcaatcggacttcacaaaacgggaggcatctccaaaaaagccgggtggatttcagcaatcattctattcggaattttagttgtattttcgcttttttcaggtttaatcaattctgtggcgggtgcataagctcatgaaaaaagtctggatcggaattggaatcgcagttatagtcgctctttttgttggaatcaatatataccggtctgccgctccaacaagcggcagcgccggcaaggagatacagacggggagcgttgaagaaaatgaaatctcatcaacggttatggttcctggcacgctaaaattttcaaatgaacagtatgtcttttatgaagcggataaagggacattagaagacattaaagttaaggaaggcgataaagttaaaaagggcacgcctttagtcacttatacaaatgagcagctgagcctggaaaaagaacagaaccagttaacgtctgaatccaaccggcttcaaattgaccaaattcaagaaaagttaaaagccttggacagcaaagaaagagaactggaaaaacaggtaggaaagaaagaagcagaaaaacaaatcgaatctgaacgaacagagcttcaaatgcagaaaaaaacagcggagatcgaattgaaacaaaccgagcttcagcgacagtcacttgccaaccgggtatcagatcttgaagtgaaaagcgaaattgaaggcaccgttatttctgtcaaccaagaggcggcatccaaaaagtcagatattcaagagcctgtcatacatatcggcaacccaaaagaccttgtcgtctcagggaaattgtctgaatacgatacattgaaagtcaaaaaaggccagaaggtcacactcacttcagatgtaatacagggtaaaacatggaaaggcacggtttccgcagtcgggcttgttccggatcagcaggagagcgctgcggcacaaggaacagaacaggcggtccaatacccgcttcaagtgaaaataaaaggaaatcttccagaaggaaagccaggctttaaaattatcatgaatattgaaacagataaacggaaagcaaatacgcttccttcaaaggcagtcaaaaaagaagatgaccaatattatgtgtatacagtaaaagacggaaaagcaaagcgagttgatgtcaaaatcggcgaagtgacagatgacctgacagaaattaaagaggggcttacccaagatgatcaagtcattttgaatccatctgatcaggtgactgacggaatggaagtgaaatcttaaatgattcagctttctaatgtgcgaaaaagctaccagatcggaaaggaaacgtttgatgttctccattctattgatttggacattcatcaaggtgaatatgtctcgattatggggccgtcaggatcaggaaaatcgacgatcatgaatattatcggctgtcttgaccggccgacttccggtacatatcaattggacggcgaagacatttcttcatataaagataaagaactggcggcagtccgtaaccggtccatcggttttgtatttcagcaatttcagcttcttccgcggctgaacgcaaaaaaaaatgtcgagctgccgatgatttactccgggataggcaaaaaagaacgtcaagagcgggctgagagagcattggaaaaggtcgggttagccgatcgaatgctccacatgcccaacgagctgtcgggcgggcagaagcagcgggtggcgattgcgagggcgatcgtgaatgagccgaaattgattttagctgatgaaccgaccggcgcgctggatacgaaaacaagcgaggcgattatggatcagtttacagcattaaatgccgagggaacgacaatcgttctggttactcacgagcctgaagtagcagattgcacgaaccggatcgtcatggtgcgtgacggaaacattgttcctgccagctccggacaaaggagtgtgggagaatgagcctgttagaaaacatcagaatggctctaagctctgtccttgcccataaaatgcgttcgatcttaacgatgctcggcattatcattggtgtaggctctgtcattgttgtcgttgcggtaggacagggcggcgagcaaatgctgaagcagtcgatcagcggcccgggaaatactgtggagctgtactatatgcctagcgacgaggagcttgcaagcaacccgaacgccgcagctgaatctacgtttacagaaaacgatattaaaggtttaaaaggaatagaaggcattaaacaagtcgttgcttcgacttctgaaagtatgacagcgcgttatcacgaagaagaaaccgatgctacggttaacggaataaatgatggatacatgaatgtcaattctttagaaatcgaaagcggcagaacatttaccgacaatgactttctcgcggggaatagagccggaatcatctctcaaaagatggctgaagaactgttcgataaaacctcccctttaggtgaagttgtctggataaacggacagcccgttgaaattatcggcgtgctgaaaaaagaaacaggcttgctttctttcggtttaagtgaaatgtatgtgccatttaatatgatgaaatcctcttttggcacaagtgatttcagtaacgtatcattgcaggtcgaatcagcagacgacataaaatcggctggaaaagaagcggcacagctggtaaatgacaatcatggcacagaggattcgtatcaagtgatgaacatggaagagattgcggccggaattggcaaagtaactgcaattatgacgacgattatcggctcaattgcaggtatttcccttttggtcggcggaatcggtgtcatgaatattatgctcgtatcagtcacagaacggacgcgggaaatcggaatcagaaaatcacttggtgcgacgaggggacagattctgactcagtttttaattgaatcagtcgtattgacgctgattggcggtctggtcgggattggtattggatacggaggggccgcgcttgtttcagccattgcgggctggccgtcactcatatcctggcaggttgtatgcgggggcgtgctgttcagtatgctcattggtgttattttcggcatgcttcctgcaaataaagccgcaaagcttgatcccattgaagcgctgcgttatgagtagcctcatgcaacatgcatgaggtttttttatgtttagtgatttctactatgaatataaaagacttttttcattaaaataagaagaaaatgtcgtacaattgtccttatttttgtcgaatttacagtttacaaaccctatagacatacgttaatatggagaaacgtgaaagattttgatagttattgaatgaatttgaatgattttagttgcctaaaccgaaaatagcgtttacaatgaaattgtattcaaaatgaatacgttttcattaggaggtgaagcatgctaactcctgaacggcatcaattgattattgatcaaatagaaaagcatgatgtggtaaagattcaagagcttataaatctgactaatgcttctgaatcaacaatcagaagagatttatcgacacttgaagaacgcggttttttaaagcgcgttcatggtggagcggccaagctttccgatatcagacttgaacccgatatgcttgaaaaatcatccaaaaaccttcacgataaactgaagattgctgaaaaagcagcttctcttttagaagaaggggattgcatttaccttgatgcaggcacgacgacattgcacatgattgattttatggataaaaccaaagatattgtcgttgtcacaaacggggtaatgcatatcgatgcattaataaggaaagaaatttctttttatctgcttggaggatacgtaaagcacagaacgggcgcgattattggaggcgcttcattgattgccatggaccagtacagatttgacaagagttttctggggacaaacggtgtccatacagaggctggattcacaacgccggaccctgatgaggcccttttaaaacagaaagcgatcaaacaggcaaaacacgcatacgtcttagcagacccttcgaagttcggagaaatttcattttcggcattcgccggaataggcgacgcaacaatcattacgactgacgctgaagagcttacattcgataattaccaagaaaaaactgtcgtaaaggtagtgaaaccatgatttacactgtaacacttaatccatctgtcgattatattgttcacgttgaagattttactgtaggaggcctgaaccgttcttcgtatgataccaagtatccagggggcaaaggcatcaacgtatcgagactgctgaaaagacaccatgtggcgtctaaagcgctcggattcgtcggcggatttaccggagaatatatcaaaacatttttacgggaagaaaacctggaaacagctttttctgaagtaaaaggggatacccgtatcaatgtaaagctgaaaacgggtgatgaaactgaaattaacgggcagggaccgacaatttcggatgaagatttcaaagcctttttagaacagttccaatctttgcaagagggagatatcgtcgttcttgcaggaagcattccatcttcactccctcacgatacttatgaaaaaatcgcagaggcctgcaaacagcagaacgcacgagttgttctggatatctcaggcgaggctcttttgaaagcaacagaaatgaaaccatttttgatgaagccaaatcatcatgagcttggagaaatgttcggcacggccattacatctgttgaggaagccgttccttatgggaaaaagcttgtagaacaaggcgctgaacatgtaatcgtatcaatggccggagacggagcgcttctgtttacgaacgaagctgtttattttgctaacgtgccaaaggggaaattggtaaactcagtcggagcaggggattccgttgttgcaggtttccttgccggaatttccaaacagttgccgcttgaagaagcattccgcttaggagttacttcaggcagtgctaccgcgttctctgaagaacttggaacagaagaatttgtccagcagcttcttcctgaagttaaggtcacacgtctatagaggaggaaacacaagtgaaaataactgagcttttaacgaagcatacgataaagcttaatattgagagcaaagaaaaagaaaatgttattgacgaaatggtcactgttcttgataaggctggaaagttaaatgaccgacaagcctataaagaagccattttaaatcgcgaaagccaaagctccacgggtatcggtgaaggaatcgctatcccccatgcgaaaacggcaagcgttatcaacccggcgatcgcgttcggacgttcaaaagacggcgtcgattatgaatcattagacggccagccggctcacttagtgttcatgattgcggcgactgaaggcgcaaacaacactcaccttgaagcattgtcaagactttcaacgctgttaatgcgtgaagaaatccgtaagcagctccttgaagctgagtctgaagatgccatcatcgacattattaatcagcacgataaagatgatgacgaagaggaagaagaagaagcggcaccagcacctgccggaaaaggaaaaattttagcggttactgcatgcccgacaggtattgcccatacattcatggctgcggatgcccttaaagaaaaagcgaaagagcttggtgtggaaattaaggtcgaaacaaatgggtcaagcggcattaagcacaagctcactgcccaagaaatcgaagatgcacctgcaatcattgtcgcagcggacaagcaggttgaaatggaacgttttaaaggcaagcgcgtacttcaagttcctgtaacggcgggtatcagacgtccgcaagagcttatcgaaaaagcgatgaatcaagatgcgccgatttatcaaggcagcggcggcggttcagcagcttcaaacgatgatgaagaagcgaaaggcaagtctggaagcggtatcggaaacacgttttataagcacctgatgagcggtgtcagcaacatgcttccgttcgtagtcggcggcggtattctcgttgcgatttcattcttctggggaattcactctgctgatccgaatgatcctagctacaacacgtttgcagcagcattaaactttatcggcggcgacaatgcattaaaactgattgttgcagttctggccggtttcattgcgatgagtattgcagatcgtcctggttttgcgcctggtatggtcggcggatttatggcaactcaagcgaatgctggattcttaggcggcttaattgccggattccttgccggttatgtcgtgattttactgaaaaaagtatttacgtttatccctcagtcacttgatggattaaaacctgttttgatttacccgctgttcggtatttttatcactggtgtattaatgcaatttgtcgtcaatacacctgtagcagcttttatgaatttcttaacaaactggcttgaaagccttggtactggaaaccttgtgttaatgggtattatcttgggcggcatgatggcgatcgatatgggtggcccgcttaataaagcagcctttacgttcggtatcgccatgatcgatgcaggcaactatgcgcctcatgcagcaatcatggccggcggtatggttcctccgcttggtatcgcacttgcaacaaccattttcagaaacaaattcactcagcgtgaccgtgaagctggtattacatgctatttcatgggagctgctttcgtaacagagggagcgatcccatttgctgcggctgatccgcttcgcgtcataccagctgctgtagtcggtgcagctgttgccggcggattaactgaattcttccgagtaacgcttccggcgcctcatggaggagtattcgtagctttcattacaaaccatccgatgctttaccttttaagtatcgtgatcggtgctgtcgtgatggcaattatcctcggtatcgtcaaaaaacctgttacagaaaaataagaaaaaaagcgtccttggttcgaaaggacgctttttcttatccggccggcagggagcgcggttaagttatgtattttattcttttttatgataaagtaaaagaagagaaacaactgacatagcaattgtctaggaggaaacactttgaccgaggaaaaaaatacgaatactgagaaaacggcgaagaaaaaaaccaatacgtacctggaatggtgtaaagcgattgtcatcgctgttctgctggctctcctgatccgtcactttttgtttgaaccgtatttagttgaaggttcatctatgtatcccacattacatgacggagaaaggctgtttgtgaataaaacagtcaactatatcggcgagctgaagcgcggagatatcgttattatcaacggtgaaacttctaaaatccattatgtaaaaagattgatcggaaagcctggagaaaccgttcaaatgaaggatgacacgctttatataaacggtaaaaaagtagccgagccttacttgtctaaaaacaagaaggaagcagaaaaacttggtgtcagtctgacaggagactttggaccggttaaggttccgaaaggcaaatactttgtcatgggagataaccggctgaattctatggacagccgaaacgggctgggactgatcgcggaagatcgaattgtcggcacatcgaagtttgtctttttcccgtttaacgaaatgcgtcaaacaaaataaaaacgccttgctggcctaggacagcaggcgtttttattttgaaaaagaagcgaccaatgcaatgcataaaaccgtgatgaacactgaaccgataatagctagcacactgaagaaaaggtgaacctgtttgttctcttttccgcgcttttctaaaagccgtttagaaaaaatgtgcgaaaatatgtaaataagggctatgcctatatataagccgatatctttggcggtaaagcctgttacggcaaggtaaaagcccgtaaaaaagatcagtaagcaatattcagtaagtgttaaaagcctcaacgtgttcctccatgagagtgtgtaattttccgagcggatgcattctctctctttaattgtaacacagctggctggtttgggtgtataagtgttttctctctgttttatcagggaatcatttctcttgccctgctttcatggtatacttttattgatgatagacatgatggaggataataaatgattgctgtaaataatgtaagcttgcggtttgcggatcgcaagttatttgaagatgttaatattaaatttaccccaggcaactgctatgggttaattggtgcaaacggtgccggtaaatcaacgtttctaaaggtgctgtcaggcgaaatcgagcctcagacaggcgacgtgcatatgagtcctggtgagcgtcttgccgtcttgaagcagaaccattttgagtacgaagagtatgaagtgctgaaagtggtcattatgggccacaaacgcctgtatgaagtcatgcaggagaaagacgctatttacatgaagcctgatttctcagatgaggatgggattcgtgctgctgagctagaaggtgaattcgcggaactgaacggttgggaagcggaaagtgaagctgcgatcctgttaaaaggccttggtatctcagaagatctgcacacaaaaaagatggcagacctcggcggttcggagaaggtaaaagttctcttggcacaggcattattcggcaagccggatgttctgctgctcgatgagccgacgaaccacttggaccttcaggcaatccagtggcttgaagagtttctgattaactttgaaaacacagttattgtcgtatcccatgaccgtcacttcttaaataaagtatgtacgcacattgccgaccttgattttaacaaaattcaaatctatgtaggaaactatgatttctggtacgagtcaagccagctggcgttaaagctttctcaagaagcgaacaagaaaaaagaagagcagattaaacagcttcaagagtttgtcgctagattcagcgccaatgcgtctaaatctaagcaggctacatcaagaaagaaacttctcgaaaaaatcacgctggatgatattaaaccgtcttcccgccgctatccttatgttaacttcacgccggaacgggaaatcggaaatgatgttcttcgcgtggaaggcttaacaaaaacaatcgatggcgtaaaagtgcttgacaatgtcagctttattatgagtcgagaagataaaattgctttcactggccgaaacgaacttgctgttactacgctgtttaaaatcatttccggggaaatggaagctgacagcggaacgtttaaatggggtgttaccacatctcaagcgtattttccaaaagacaacagcgaatatttcgaaggcagtgatctgaaccttgtagactggcttcgccaatattctccgcacgaccaaagtgagagctttttacgcggtttcttaggacgcatgctgttctctggagaagaagtccacaaaaaagcaaatgtactttccgggggagaaaaggtccgctgtatgctgtcgaaagcgatgctttctggcgccaatattttaattttggatgagccgactaaccatttagacctggagtccattacagcgctcaataacggcttaatcagctttaaaggcgctatgctgtttacttctcatgaccatcagtttgtgcagaccattgccaacagaattatagaaattacacctaacggcatcgtcgataagcaaatgagctatgacgagttccttgaaaatgctgatgtgcagaaaaaattgactgaactatacgcggaataaaaaagcagagatttctctgctttttttgatacctaaatatgaaaggagatcacaacatgaaatttttggttgtcggagcaggtggagtaggtgggtatattggcggacggctttcggagaaaggaaatgatgtgacatttctcgtgcgccaaaaacgagctgagcagcttaaaaaaaccgggcttgtcatccatagtgaaaaagggaatgtatcatttcagcccgaactaatcagtgccggagaaacagggcaatttgatgtcgttatcattgcttctaaagcatactcgcttggtcaagtgatagaggatgtcaaaccatttatccatcaggaatctgtcattatcccttttttaaatgggtaccgccactatgagcagctatttgcggcattttcaaaagaacaggtgctgggcggcctgtgttttatagaaagtgctttagacaacaaaggagaaattcatcatacgagcgcatcgcatcgttttgtatttggagaatggaacggcgagcgtacggagcggataagagcgcttgaagaggcattttcaggtgtgaaggctgaagtcatcattagcgggcatatcgagaaggacatttggaaaaagtatctctttattgcagcgcaagcggggatcacaacgttatttcaacgaccgcttggcccaatcctcgccacagaagccggacgtcacacggcccaaactcttattggggaaatttgcgctgttttacgaaaagaaggtgttccggctgatccggatcttgaggaagagagctttcgtacgatgaccagcatgtcttaccatatgaagtcctccatgcttcgggatatggaaaacggccaaacgactgaaggagaccacctgcatggatttttgcttgaaaaagcaaaacgtttatctctcgctgcaccagtattagaaaccgtttatgcgaatctgcaaatgtatgaagcagaaaaataaaaaaaggaggcgaaaaagcctccttttatttacttaaaaagcccaatttccgtttctgaagataggctctcttttcccgtctgccgtaattccgtcaatattcatatccttagaaccgatcataaagtccacgtgtgtaatgctttcatttaggccttctttgacaagctcttcacgagacatctgctttccgccttcaatattaaaggcataggcgcttccgatcgccaaatgatttgacgcgttttcatcaaacagcgtgttatagaaaagaatgtttgattgtgatataggtgaatcgtaaggaacaagtgccacttcacctaaatagtgagaaccttcatctgtttccaccagttcttttaaaatatcctcacctttttcagctttaatgtcgactatacggccattttcaaacgtcagggtgaaattttcaataatatttccgccgtagcttaatggttttgtgcttgataccactccgtcaaccccgtctttttgcggcagcgtgaacacttcttctgtcggcatattggccataaactcatggccgctttcattcacgcttcccgcacctgcccaaacatgcttcctaggcagcttaattgttaaatcagttccttcagcttgataatgtaaggcagcgtaatgtctctcgttcaaatggtcaactttttcatgaagattctggtcatgattgatccacgcctgaaccgggttgtcttcatttacgcgcgtcgctttaaaaatttcttcccacagaaggtggatcgcttcctcctctgatttgccaggaaacaccttgtgagcccagcctgctgatgccgcacctacgacagtccagctgactttgtctgattgaatatattgtctgtatgtatgtaatgctttgcctgctgctttttggaatgccgcaatccgtttggaatctataccttttagcaagtctgggtttgacgacacaacagaaatgaaagcagctccatttttggcaagctcttctctgccttttgcttcccattcaggatattcttcaaatgcttcaaacggcgcaagttcgtattttaatttggcgacttcgtcatcctgccaattcacggtgacgttttttgcgcccttttcatatgcgtgttttacaattaaacggacaaaatcccgaacgtctgttgaagcatttacgactacatactggcctttttggacattaacgccgacttctaccgccagctgtgcatatgtatttaatttctgtgaaaatgaatccatgaatcattcctccaagcttttttctcatcatatcaaatatgatcctataaaggaaagaaggagcccaaagtgaaaaacccaaaacgacacgtcttgggtttttcaatattatggatgattcagttttacagtgccgcctgcaggcgaatgaggcatatttgccaaagaaatgctcatgcctccaagaataattccgcttaaaatggctgcgatcgctactcttcttcctaaatctcttagcatctgtttcctccttaacgtttctccatttcccacaatatgaaggaagtgaggaaaaaagaagcaagaaatttgccgcgtgtgagaattttgcgggtaaagactatttaattgccttttgcagcttatcaatcacttctaaagaacggcctgtgccgattgctacagattcaagcgggttttgcgccacgtgtacaggcacgacaatctcttctgtgagccattctttaattccattaaggagcgcgccgccgcctgttaaaataacgccgcgatcaacaatatctccgctcaattcaggcggacagtcctcaagtgtcgctctgatggcttcaagaatatgcaggagggattcacgcattgcatcttgaatttcgttggattgaagcataatggtttttggaagacctgtcacgaggtcgcgtccccgaatttccattgcctctggtatatgttcaatcagagcatggccaatttccatttttacctgctcagctgtgcgttcgccgatcagcaaattgtattttttacggacgaaagaaacgatatcctcatcaagctggtctccgccgatcctgatagaatggcaggaaacaacgccaccgaaggaaataatagcgacctctgtcgtccctccgccgatatctactaccacattggcaaccggctcatcaaccggtaaatccgctccgatggcggctgcaactggctcttcgattaaatgaacgtttttcgcgccgcaatttttcaccgcatcactgatggcgcggcgttctactgctgttgagcctgatggtgtgcaaacgactacgttcggttttctgaacgacatgccgatgctttttgcggcttttttcataatgtgctttagcaggtcagttgtcatatcatagtctgcgatcacgccatctttcatcggtctgacagcgacaatttttcccggtgttttaccgatcatgtttttcgcatcagctccgattgcaagcactgcttttgtcgtcgtatccactgcgacaacagatggttcatttaggataatccctttatttttgctgtaaacaagtatattagctgttcctaagtcaatcccgatttcagttgattgaaacatgttttcacccaatctctatcctaatttaatatgattctacatttaaagtttctcagaaatactgcgatttttgggggtgtgcgtcggtaaagaaatgtttttgtaaaaaatcaaggaactgtgtaacagaagtaatacatttttcagttttatggaaaaaatatcttgtaattcttatagaaagcgggaaactttttcaaagtttcattcgtctacgatatattgaggtacatccttaaaacattacatgagaaaagaaacatttaaaggaagaagggtttttatgaaatcaataggtgttgtgagaaaagtagatgaattaggccgcattgtcatgccgattgagttgagacgggcattggatattgccataaaagacagcattgagttttttgttgacggagataaaattatcttgaaaaagtacaaacctcatggcgtttgtttaatgactggagaaatcacttcagaaaataaagaatacggcaacggtaaaattacgctaagccctgagggtgcacagctgcttctcgaagaaattcaagccgctttaaaagaataaaattatgctaaaaaaggcggagtgatatcacctccgccttttttgcgtgccaatttttgattaccgccgcctaagatatgacatcaagatatttggtaatgaatgatttgggatactttacatattttactcaattatttgtcgaagaatggtacaataagtagagaaacacaagcggcaggtggtcatatgagaaaatatcaagctcgtatcatttccatcattttggcaatgatttttataatgttttgggattatttattttattttataggcaaaaacccgattaattggcctgttgatattgtgtatactgcagtcacgctggtaagtgtctggatgctggcttattatattgatgagaaacagcagctggttaagaaaatgaaggataacgaatggaagtataaacagctttctgaagaaaaaaaccgcatcatggataatttgcaggaaatcgtatttcaaacgaatgcaaaaggcgaaattacatatttaaaccaagcgtgggcatcaataaccggcttttcaatcagtgaatgtatgggaacaatgtataacgattacttcataaaagaaaagcacgtagccgaccacattaacacccaaatccaaaacaaagcgtcttctggcatgtttacggcaaaatacgtgacaaagaacggcacgattttttggggagaagttcattataaactttactatgaccgggatgaccaatttacaggcagcctgggtacaatgtcagatatcactgagcggaaagaggctgaagatgagctcattgagattaatgaacggctggcgagggaatcccagaaactatcaatcacaagtgaacttgccgcaggtattgctcatgaggtcagaaaccctttaacatctgtcagcggtttcctccagattatgaaaacacaatatccggacagaaaagactattttgacatcatcttttcagagattaaaagaatcgatttagtgctcagcgagctgctgctgcttgcaaaaccgcaggcaatcagatttaaaacacaccagcttaatgagatcttgaaacaagtcacgacattgcttgataccaatgcaattctgtccaatatcgtcatagagaaaaatttcaaagagacagatggctgtatgattaatggagacgaaaatcagctgaagcaggtctttatcaacatcattaaaaacggaattgaggcaatgccaaagggtggtgtcgtaaccatttcaactgctaaaaccgcctctcatgcagtgataagcgtaaaggatgaaggaaacggcatgccgcaggaaaagctgaagcagattggcaaacctttttattcaacaaaagaaaagggcactggactgggacttcccatttgtttgagaatcctgaaggaacatgacggggaattgaaaatcgaaagtgaagctggaaaaggcagcgtctttcaagtggttttgcctttaaaatcagacagctgagaggagaaaaataaagtgaactcgcttctgtttgtatacgggacattaagaaagcatgaaaaaaaccatcatttgctggcacaatcggcatgtatcaatgagcaggcgagaacaaagggaagtttgtttgctgcaaaagaggggcccacagctgttttaaatggtgaaggctatatatacggcgaagtatatgaagcagatgaattgtgtatacataagctcgatcaattttttcaaggatatcataaacaaacggtgtttgtagaaacggatgtcgggattaaaaatgcgcttatttattttatgaacaaagacgggtttgccggctttacgaaaataagcagcggcgactggaaagaacatcagatgatcagcaaatcgaaaaatcccatttattattttgcctatggatcatgcatggataatgcccgctttcaaaaagcgggagtcgatcactattttcaagatacagtaggaagggctgttttaaaaggatacacaacccgcttcacgctaaaaagggatgacggttcaagagcggacatgttggaagacggaggaacaacagaaggcgttttataccgtatcccttattctgctctctcctatctatataaaagggagggcgtcgaatctcttacgtatcggccggcatttgtagacgttgaagctggcggtaggcactacaaagactgcttaacctttctcgtcctccaaaaagaagcggaaattgccccgcctcagcactatcagattgaaatcgaacgcggagcggagctgtatttgtcgcctgagtttactgaaaagctcaagcggcatatgaattcgctgccaaaaggataacactgtaacaaaagaatatgataaaatttgatcaatatcatgtcatataaaggagcaccacgatgaaaaaagaatttgcggtaattgggctgggccgttttggtggcagtatttgcaaagcattaagcgaagaaggcgtcgaggttatggcaatggatatcgatgaagataaagtcaacgagtatgccaagattgcatctcacgcagttatcggtgattcgacagacgaatctgtcctgaaaaatttaggcctgcgaaattttgaccacgttattgtagcaatcggggaaaatattcaagcgagtattttaacgacactcattctgaaagaacttggcgtccatacgattacagttaaagcgcagaacgattatcacgaaaaagtgctgtctaaaattggcgcggatcacatcgtccacccagaacgcgatatggcaaaacgaattgcgcataatatcgtgtccaacaatgtacttgactatttggagctgtctgaagagcatagtcttgttgaaatcgtagctaacagccgcctggctggaaatacacttctcgatttagatattcgcgcaaaatacggtattaatatcgtagccataaaaaggggcaaggaagtcatcgtatcaccgcttgcaaccgaagtcatccaccaagaagatatactcattgttattggatcagttacagacatctcccgttttgaaaaaagagttcttcatactaaatagcagtcaaataagccgtcctcaaagggcggtttttcatattatcagaatataacaactttaatgaactgagcgccaatttcttaaaatttcattgactaagcacaggcgttccgatagcatattgtaccatataataaaaaagaggaggggcctatttgaataaagaagcgctagtcaataggctgaatgcttcagcccaaagacaaaaagctgatatcgtcattaagaacggaaaaatcatggacgtatataatcaagaatggatatatgaagatattgcgattacagatggagttattgtaggcctcggtgagtatgaaggtgaaaataccattgatgcagagggacaaatgattgttccgggttttattgatggacatgtacatattgagtcgtcaatggttacaccgattgagttcgctaaagcagtgttgcctcatggcgtgacgacggttgttacagatccgcatgagatcgcgaatgtgtctggtgaaaaagggattgtgtttatgcttgaacaagctcggcatacaccgctgaatatccattttatgcttccttccagtgtgcctgccgcaagttttgagcgatcaggcgcaattcttaaagctgcagatctcaagcctttttatgaagaagaagaagtattaggactggctgaagttatggattatgtgtcggttcagcaggctgaagaagacatggttcagaaactgctcgatgcccgtgttgcaggaaaacggatagacggtcatttagctggtttatcaacagacctcattaacatttacagaaccgcatttgtcttaaatgaccatgaagtaacatcgaaggaagaagcccttgatcgtatcagaaggggcatgtatgtcatgatgcgtgaaggatcagtcgccaaaaacacgctcaatgtgctgccggcggtgaatgaaaagaacgcacgccggttctttttttgtacggatgataagcatgtggatgatttattgtcagagggaagtgtaaaccatcaggtgaaaatggcgattcaagccggacttgatccgtttttagcctatcaattaggaagcctcaatgcggccgaatgctacggattagatacaaagggagcgattgccccgggttttgacgctgatttgctctttgtatctgatctggaaaatgtcactgtcacaatgacgatggtaaaagggcagactgttgctgaagacagcaaagcggtctatcatgattatgcttcaactgcagcaccagatcaggcactgcttgattctgttaagcttgctgatcctcttaacaaacaggattttcatatgccaatcgattcagagcagcagatcaatgtcattcaaatcataccaaatcagcttgaaacaagattagtacaagttccggctcctgttgcccgcgaatttgagcctgacactgagcttgatttgttaaagattgcagttgttgagcggcataaaggattaaaagaaaccggacttggtgttgtgaaaggttttggattcaagagcggagcgattgccacaaccatttcacacgactcccataatattattgctgtcggaacgaatgatgaggatatcgcggcggcagttaataagctgcaggaaattggcggaggattaacgattataaaaaatggggaagagctccattcagtaccgctgccgattgcagggttattatccgaccaatctgcagagcaagtgaatcaaagcttgctgacgcttcatgataaattgccgttaatcggtttcacaggcggatttaatccatttttgacattgtcgtttttagcgttgcctgtcattcctgatattaaaatgacgactacgggcttattcgatgtaaaatcatttcaacacatatcactgcaataaaaagaggcactcccttagggagtgcctctttttttaaacctccataatgatcggcaggatcattggacggcgctttgttttttcgtacaagaaaggtgcaagcgtgtctgtaatctcgtttttgatttcagaccattgagtcgtttttcgttccattactttttgtaagtgatttgaaatgagctcttgagcgtcgttgatcaagtcgccagattctctcatgtacacaaatcctctggaaatcaaatctgggcccgctgaaatcttgaagtcgtccatgtcaatgctgacaacaacgatgacaagtccttcttcagagagaattctgcgatcacgaagtacgatattgccaatatcaccgataccgcttccgtcaatgtacactgaaccggacgggatttttcctgcaactgaagcctcgtcgcctttaagcgctaatacttcaccattatccatgataaagcagttttcctctgggatgccacaatctgttgcaagtttgacatgcatcttttgcattctgtactcaccgtgaatcggcatgaagaatttaggcttgattaaacgaagcatcagcttctgttcttcctgtccgccgtgaccggatgtatggatatcgttaagagggccgtgaataacctcagcacccgcacgatacagctggttgattgttcgactcacgctgattgtgttgcctgggataggggatgaagaaaatacgactgtatccccaggattgattgaaatttggcggtgtgtgccgtttgcaattcttgataacgccgccattggttccccttggcttcctgtacataaaattgttactttattagcaggcatacgattgatttcgttatgctcaataaacgtatttttaggacagttaatataaccgagtgtctgtccaatttcgatagccgattccatactgcgtccaaatacggcaacttttcttccattttgtacagcagcttcaattacctgctgcaagcggtgaatattcgacgcaaatgtagcgaagataattcggccgtccaccttgcggaaaatgtcatgaatgctttctcctacacggcgctcagacatggtaaactccggattttcactgtttgtgctgtctgaaagaaggcacaaaacgccttctttaccgatttcggccattttcgttaagtttgccggctcgccgactggagtaaagtcgaatttaaaatccccagtatgtacgatgtttccgggcggcgtttttacaacaatgccgtaggaatccggaatactgtgtgttgttctgaagaatgacacagccgttttgcggaactttacaatatcatcctcgccgataatgttcagtttcgtctgtcttaataatccatgctcttcaagtttattccgaagtaagccgatcgcgagttttccgccgtatacaggaatattcacttgtctgagcaggtatggaataccgccgatgtggtcttcgtgcccgtgggtgataaaaagccctttgattttatcttcgtttttgactaaatacgtataatcagggatgacgtagtcaattccgagcagttcgtcctcgggaaacttgatccccgcatcaatcagcacaatttcatcctggaattgcaccgcgtacgtatttttaccgatttcgcccaaacctccgagggcgaaaacagcagtctgatcattttttacaaatttcataccgctcataactccaatactttaaaattttcgctctgttgttcatattctaagaatgcaccatcaacaggtgtaataaactcaatattaaatttcttttctttcagctttgttctgacgtcacgctcagatacgccttcaatataaagtgaatctgtcttttcccgaacaggtacttcgtcagccttctcttgataaaataccttataaatcattccaaatctctccttaaatgccgtatgttagactcgctcattctattatattcgaaaacggaatataaggaaagccttgagcaaaataaggatctctcaaaaagtgaaagatcccttgtcaggcaattgctttcttacggagcattccgttccattgtcttctgagtttctttcttaatttacgcagcattagccagttcctcctttattaaaatatttgtcccagagtttttttatacaaatagtatacggagattgaggaagacttttcgtggttattaatggaatttaatatgatttttgaacgaaattgtttgctgaatgacaatctttttgtatgatgagggtgggaattgcagaccaagacgataaaggggaagttgcgatggattctaaattaatcttttttgatattgacggcacaatatatgatcatgataagaatataccggaaagtacgagaaaaaccgtggcggagcttcagcgccaagggcatcatgtgtttattgccagcggccggtctccatttttggttaagccgattttggaggagctgggcatccactcatttatttcctacaatggacagtttgttgtctttgaaaatcaagtgatttataaaaatccgctgcctaaagatgcaatcaggcgattattaaagcaggcggatgaaggcaagcatcctgttgtgtttatggctgaggacacgatgaaagcgactgttgcggatcaccctcatgttctcgagggaatcggcagccttaaaaccgattacccagagaccgatgaccttttttatgaaggaaaagaaatttttcagcttcttttattttgtcaggatgaagaagaaaaagcttatgccgcttttcctgagtttgatctagttcgctggcatgagctatcgactgatgttctgccgcacggaggttcgaaggcagaaggaatcaaaaaagtgattgagcgtcttccgtttgatatcggcgatacatatgctttcggcgacggattaaatgatctgcaaatgattgaatatgttgggacaggcgttgctatgggaaatgctgttcccgaactgaaagaaatcgcggactttgtaacaaaaccggtggacgaggatggaattgcatacgctgtcaaagaattgggccttttaaaataaagaaacggctggcattgtgccagccgctttttctattagcgctcaattgcgattgcattttcaggttctttgaaaggattttccttatcaatatgatcatagaacataacaccgttcaaatgatcgatctcatgctgaaacacaatagccggaaatccttttaaacgaatatcaatattttcgccttctagtgttgttccttttactctgatgcgagaatagcggggaacataaccgggaatcgcttcatccacagagaggcagccctcgccgcttgttaagtagcttttttcaactgaatggctgacgatcttaggattaaacagagcatagctgtataatttaccggaagcatcttccgcatgaacggcgatcattcgttttttgatattaatttgaggagctgcgagtcctacgccagggcgcagcttgtatttttcggctaattcaggattttggctgtttttaacaaattcgatcatgtcggccagctgctgtttttctgcatcagttggaggcagctcaacaggttcggcagtctctctgagggctggatggccgtcacgtacgatgttttccatagtaatcaagaaacttcactcctaaagcttaatatgtaaattatatcggatttcttcacaaaggtgcaacgaaacgaatgaccagccgtatatggctggtcaatttcatgctgtgtggttagcaacagcctccgcctaaataagcagctccgacaatgattaacagaatgaataaaacaacgattagcgcaaaggtgcggccgtagccatatccgcagccaccatatccgtaaccaccataactgcagcagcctccgccgtaaccatatccatacatattacataacctcctcttttaattacgccagagcctttataagtaggcatagcgtctaatataacctatgtaaaaacaaaaaagttgtatggtcatctgtcctgatttttcacttttttgatttaatttcagtattgcattaatacagcacgactattgccaaatgtccccatggattctatagtagaaattgtcaagattgggggatttaacgtgaaagacgctataaaacggaggcctggaatcaagatcggagctttttgtgccatggcactgatattaacaggatgcatgggacaggacccggttgattcacttcatcattcattagaaaaagccgcggaatcggaaaagccgtttcaagaagaacaaaacacactcaaagaattagaggccaaagaaaatcagctttacgatagtgttatgaagctcaatatggatgattataaaaaaattgttgctttatctaataaggcgcttgaaaatgtcagcaagcgcgaagaacacctaaagcttgaaaatgacagcatgaaaaaatcggaaacagaatttgaggaagcaaaaacgtcagcggaacatattaaggaaaaagacataaaagaaaaggccgatgctgcagcaaaccatatggagaaaagatatacatcatatggcactatgtataaagagtataaaaaagcgcttgagcttaataaaaaactgtatatgcagctgaaagacaaagacttgacaagagatgatctggatcagcagatcgataaagtcaatgcttcttatgaaaagatccttaaatatagcggagaatttaatgaacaaaccgaaaaatacaataaagcccgggaagatttatatgatgctgcaggctatcgtgtgaaaaagagctgactcgatcagctcttttttgaatgaaatgcgattcggatttcattcaaaattttcatttctattgtagtacagcatagtaaggtatactagtacagttttgggcgcggttggcatctgtttttttgttgaaaatgtaaagcgaatacatttattgaaaatcagcgatgaaaacgattgacggttcttctttatttggtgtaaactaatccatgttaagcggtgttgtattagttttttacaacttcgaaataatacagttcaaagcagagtgtaactatcctacataaaaggttttggcaaactggggatcggctaaaatataatacgacttactgctgatactttagggtaccctaagtttgtatgtataaaaggaatgcacgtctaatgactgtttaaaagaaaggaagaggtgacttagtatggctgcaaaaacgaaaaaagctatcgttgacagtaagaagcaatttgatgccattaaaaagcagttcgaaacgttccaaattttaaatgaaaagggagaagtcgtgaatgaagcggcgatgcctgatttaactgatgatcaattaaaagagctaatgcgccgcatggtatttacgcgtgtgcttgaccaacgctctatctcattaaaccgtcaaggacgtctcggattttacgctcctactgcgggtcaagaagcttctcagattgcaacgcatttcgcgcttgaaaaagaagactttgttcttcctggataccgtgatgtgcctcagttaatttggcacggccttccattatatcaagcgtttcttttctctcgcggacatttcagaggaaaccaaatgcctgatgatgtgaatgccctttctccacaaatcattatcggtgctcaatacattcaaacggccggtgttgcgctaggtcttaaaaaacgcggtaagaaagctgtcgcaatcacttacactggtgacggcggagcttctcaaggggacttctacgaaggaattaactttgccggagcttataaagcacctgcaatcttcgtggtacaaaacaaccgttacgcgatttcaactcctgttgaaaaacaatctgcagctgaaacaattgcacaaaaagctgtagctgccggtattgtcggcgtacaagtagacggaatggatccgcttgctgtatacgcagcaactgctgaagcacgcgagcgcgcaatcaacggcgaaggtccaacactaattgaaacacttacattccgttatggcccgcacacaatggctggtgacgatcctactaaatatcgtacaaaagaaatcgaaaatgagtgggaacaaaaagatccgcttgtacgcttccgtgcgttccttgaaaacaaaggcttatggtctgaagaagaagaagcaaaagtaattgaggatgcgaaagaagaaattaagcaagcgatcaaaaaagctgatgctgaaccgaagcaaaaagtaactgatttaatgaaaatcatgtacgaaaaaatgcctcacaaccttgaggagcaatttgaaatttatacacagaaggagtcgaagtaagccatggcgcaaatgacaatgattcaagcaatcacggatgcgttacgcacagaactgaaaaatgacgaaaatgtcttagttttcggagaagacgttggtgtaaacggcggcgtattccgtgcgacagaaggattgcaaaaagaattcggtgaagaccgtgtgtttgacacgccacttgctgaatctggtatcggcggtcttgcccttggtttaggcttaaacggcttccgtccggtaatggaaatccaattcttcggatttgtttatgaagtaatggattcagtttctggccaaatggctcgtatgcgctaccgttctggcggacgctggacttcacctgtaacaattcgttctccattcggcggcggtgttcatactcctgaacttcacgctgacagcttggaaggtcttgttgcacaacagcctggtatcaaagttgtgattccatcaactccttacgatgccaaaggacttttaatttctgcgatcagagacaatgatcctgttgtcttcttagagcatatgaagctttaccgttctttccgtcaggaagttcctgaagaagaatacacaattgagcttggaaaagctgacgtgaaacgtgaaggtactgatctttcaatcatcacttacggcgcaatggttcatgaatcattaaaagctgctgatgagcttgaaaaagacggcatttctgctgaagttgtcgaccttcgtacagtaagcccacttgatatcgatacaattatcgcctctgtagaaaaaacaggacgcgcgattgtcgttcaagaggcacaaaaacaagccggtattgctgcaaacgtagtagcagaaattaatgaccgtgcgatcctgagcttggaagcacctgtacttcgcgttgcagcgccagatacagtatttcctttctctcaagcggagagcgtatggcttccaaaccataaagacgttcttgaaacagcaagaaaagtgcttgaattttaatcaaactgaataatcgagagggaagatgaacgttttccctctattatatatctgttttcaatgcttacgatgtaaactttaaaattgcttaatcaaactaggaggtcgagaactgtggcatttgaatttaaacttccagatatcggggaaggtatccacgaaggcgaaatcgtaaaatggtttgtcaagcctaacgacgaggtagacgaagatgatgtactggctgaagtccaaaatgataaagcagtagtagaaattccttcacctgttaaaggaaaagtattagaattaaaagttgaagagggaacggttgcaacggttggacaaacgattattacgtttgatgcacctggttacgaagatcttcaatttaaaggcagcgacgagtctgacgatgcgaaaactgaagcacaagttcagtcaactgcagaagctggacaagacgttgcgaaagaagagcaagctcaagagcctgcaaaagctactggcgcaggacagcaggatcaagctgaagttgacccgaacaaacgcgtgatcgctatgccttccgtacgtaaatatgctcgtgaaaaaggcgtagacatccgtaaggttactggttcaggcaacaacggacgtgttgtaaaagaagatatcgacagctttgtaaacggaggagcgcaagaagctgcaccgcaagaaacagctgcaccacaagaaacagctgctaaaccggctgctgcaccagctccagagggcgaattcccagaaacacgcgaaaaaatgagcggtatccgtaaagcaattgcaaaagcgatggttaactctaaacacactgctcctcacgtaacgttaatggacgaagtggacgtaacaaaccttgttgcacatcgtaaacagttcaaacaagttgctgctgatcaaggaatcaagctgacttacttgccttacgttgtaaaagctcttacatctgcactgaaaaaattccctgttttaaacacgtcaattgacgataaaacagatgaagtcatccaaaaacattacttcaacatcggtatcgctgctgacactgaaaaaggcttgcttgtaccggttgtgaaaaatgcagatcgtaaatctgtctttgaaatttctgatgagatcaatggccttgcaacaaaagctcgtgaaggcaagcttgctccagctgaaatgaaaggcgcatcttgcacaattacaaacatcggttctgccggcggacaatggttcactccggttatcaaccatccagaagttgcgattcttggtatcggacgcattgcagaaaaagcgattgttcgtgatggcgaaatcgtagcagctccagtcttagctctttctctcagcttcgaccaccgtatgatcgacggagcaactgcgcaaaatgcattaaatcacatcaagcgtttactgaacgatccacaattaattttaatggaggcgtaatgttatggtagtaggagatttccctattgaaacagatactcttgtaattggtgcgggacctggcggctatgtagctgccatccgcgctgcacagcttggacaaaaagtaacagtcgttgaaaaagcaactcttggaggcgtttgtctgaacgttggatgtatcccttcaaaagcgctgatcaatgcaggtcaccgttatgagaatgcaaaacattctgatgacatgggaatcactgctgagaatgtaacagttgatttcacaaaagttcaagaatggaaagcttctgttgtcaacaagcttactggcggtgtagcaggtcttcttaaaggcaacaaagtagatgttgtaaaaggtgaagcttactttgtagacagcaattcagttcgtgttatggatgagaactctgctcaaacatacacgttcaaaaacgcaatcattgctactggatctcgtcctatcgaattgccaaacttcaaatatagtgagcgtgtgctgaattcaactggcgctttggctcttaaagaaattcctaaaaagctcgttgttatcggcggcggatacatcggaactgaacttggaactgcgtatgctaacttcggtactgaacttgttattcttgaaggcggagatgaaattcttcctggcttcgaaaaacaaatgagttctctcgttacacgcagactgaagaaaaaaggcaacgttgaaatccatacaaacgcgatggctaaaggcgttgaagaaagaccagacggcgtaacagttactttcgaagtaaaaggcgaagaaaaaactgttgatgctgattacgtattgattacagtaggacgccgtccaaacactgatgagcttggtcttgagcaagtcggtatcgaaatgacggaccgcggtatcgtgaaaactgacaaacagtgccgcacaaacatacctaacatttatgcaatcggtgatatcatcgaaggaccgcctcttgctcataaagcatcttacgaaggtaaaatcgctgcagaagctatcgctggagagcctgcagaaatcgattaccttggtattcctgcggttgttttctctgagcctgaacttgcatcagttggttacactgaagcacaggcgaaagaagaaggtcttgacattgttgctgctaaattcccatttgcagcaaacggccgcgctctttctcttaacgaaacagacggcttcatgaagctgatcactcgtaaagaggacggtcttgtaattggtgcgcaaatcgccggagcaagtgcttctgatatgatttctgaattaagcttagcgattgaaggcggcatgactgctgaagatatcgcgatgacaattcacgctcacccaacattgggcgaaatcacaatggaagctgctgaagtggcaatcggaagtccgattcacatcgtaaaataattttcatatcaaaaacagccctctctcaaagcggggctgtttttttattttgacagcacatgctgtaatggtttaatgatgtcttctttctttttcacacatccctcgattttcaccacgacatggcgctgatcaacaaccataagggtagggacagtttcaatctcatcttcccagccttcttttttatcatagaccttcattttatctatttgctcgggataatctttttctaaatcaagcagtgcatcgtaataaggcgcttcctgatctatttggttctcatcagaaaaaaacaggatttgtgtatggtgaatgttgtcaatccggctttttttcatcggattgatggtggaaagcgtacagcccgataaagcaaatactattatcagcatggggaataccgcgcgatatcgcatctatcttctcctctgtataaacagtagttaactagctttagtttatcacgagaggcggcttaatctgcttcttgttacctaattgttatataattgaaaccgtttttaaagtgagattacatattatatcaatcgtttaaaatagcaacctggggtatattgaattttttgctgcattcttggatgaaagttcaagaaaacgtgaaattacattatgtgctgtggcatatatatcgagtaaagcttctgtatgaagaagatattgtatgagggaaaatggaaaagcacggtctatatgacgatctaaaattaaatgtgttatacagtttattgttgacattttaaatgtgacatattaatataataacaacaaaagaaattaagcgttttcaaatttcaaagaaatggggaataagagatgggtacgattgtttgccaagattgcaacgaagccattcattactttgaagatgagaaagtgacaacattatatggaacttgctgcggacaatgtcaatgtcctgttgatgaagagtaaaaaaaagcatgcggcttaaagccgcatgctttttattttttattgaattgctttttgttctttgatgacccggatcatatgtaaagtcgagtcctcaggtccttgaacagggaggcctgcgtcaaggtttttaaaaatgtagctgatgttttcttctgtaataatttctcctggaatgaagattggaataccaggcggatataccatgacaaattcagcaataatccgtccggatgcttcttttaatgggatgacttccgtatttgcataaaaagcatcacgcggagtcattgccaataaaggtatttctggaagcagaacctcagtttgctgatgtgttacatcttgttctgacatttgctgtgcgatctcagttaaagcctctacaagccggtctgcatcattttggctgtcaccaggagtgaaaatacacaaaatattgtacagatcagaaagctcaacctcaatattaaaggattcacgaagccatttttccacgtcatgccctgtcaggccaagacttttcacagagataatcaattttgtcggatcatagctgtaagctgctttcgaaccaagaatctcagaaccgacacaataaatgccttcaatctggttgaggcgatctctcgtctgattggcaagcttgagtgtttcctcagcaagctggtggccttctgttgcaaggcgttttctggcaacatccaaagaaacgagaagcaagtaagaagttgacgtagttgtcagcatgctcaggatggattgcactctgtcttttgatacaaggccctctctcatgtttaaaatcgaactttgcgtcagtgatccgcccagcttgtgtacacttgtcgctgctatgtccgctcctgcctgcatagccgatagcggcaattcgtcgtgaaaatgaatgtgaacgccgtgtgcttcatccacaagcactggcacatcaaacgaatgagcgagttctacgatgctttttaagtcggctgcaacaccgaaatatgtcgggttgatgacgagaagcccttttgcatccggatgctcggtaagcgcccgtttagcagattcaagtgtaattccgtgggagatgcccaattcattgtcaatttcaggatgaataaaaattggaaccgctccggaaaatacaatagctgtcataattgatttatgaacatttcttggaataataattttatcgccaggtccgcaaacagccattaccattgtcataatggcgccgcttgttccttgaacagaaaaaaatgtatgatccgctccaaatgcttcagcagccagatcttgtgcttgtttaataatgccttttggcgcgtgcagatcgtctaatggttcaatattaatcaaatctatgcttaacgcgttttcaccgataaattgtctgaattctgggtccattcctgccccttttttatggccgggaatgtggaattgaacaggctgtctgcttgcatgctttttcagtcctgtgtataagggtgtttcatgttgcgacaattgttttcccacctttgtaatcatacctatgcataatagtgtgtattaaaatcagtttctcaaccgttttttagacgtaaaacaaatgaattatattatgaacttgaaagaatgtaaagaacaatttatgatcaaatgaagatgctttctcttaagggaattaaatctacaaggagtgaagaaaatggagtatcaatatccgatgaatgaagattggacaaccgaagaagcagtggatgtgattgcatttttccagcaggttgagcttgcatatgaaaaaggggcggatcgtgaagaactgcttaaagcttaccgccgtttcaaggaaattgtaccggggaaggccgaagaaaaaaagctatgcggcgagtttgaggaacaaagtacatattctccttatcgcacggtcaaacaggcgagagaatctgatcacgcgaagattaagatgtaagaaaaagagccgggggatatcccggctcttttttatgcttgtgatactttttgggtgagacggtacagaaaagcaagctgcttaaaggcatcgtcgatacgctgaaggaattcctggttattcatattcagcacttcttctttttggagctggatgccgcataacagctcagctttctttacagtctgcaaacgctcaaacagtgtcttcagctgttccttgtccatttcagactgtttatgtactcccggttttgtgtgatctgcagaccaaacgaagctgtcagggatatttttcgtaatggtttcttggttcatttcaagcaatttgccgtattcttctttgataggggattcataaataatcgcaaaccacacaaagacgtagctttcccataaaccaatttggaaatgtggcagttttttatagcctcttttgctgtttgcgaacgccacccagctgtcagcagggggattgacggatcttcttgcatgctttgccacatgcggaaatatttcatctccggttaaagctgataaagttggggcaaaatgttcgcctagagctgtaagcttcggacggaccgtctcttttaatacttccatgcgcgcgtctaagccttctattgtaaatgtgttaaagtcctcttcagtgaaacgcatttgtgtcatgattttcctccttcatgctaagtatacatattttatcacagttcatacgagcttcaaaaagattgagcgcgtttgaagtaaggggaaatgtggtaataaacgagtaggtaaacacacaattttcagaatcatgttgcgcgtaaatagaacaatcatacgatataagaagtaatcattgttgaatggcaaaatgggatgcttttttacaaacaaatgatctctggaaggggcgaaagacaatgaggcaagttgtaaaagagggatttaaggaagagaaaaacaatcgtgttgctgtctggagactagaggttgattatgaattggcaaccctatatgaagcaatgcagaaagaaaatgaagagcagattgaacaaagcaaaaacaaacttgagcgacttagaaaagaatggattcgtcttaacgggtaaaaaagcgatagtgaaaacgaaccgcatgaatggttcgtttttacgtgagaagggatatttttcattttccttgctttttcattgccgttatcagtatcctataaaataaaaggtctacatagaagagaggtacgaacgaatgacaaattggacggaaattgatgagattgcaaagaagtggataagagaagcaggcgcgagaattacacaatccatgcatgaaagcctgacaattgaaacgaaatcaaatccgaatgatttagtcaccaatattgacaaagaaaccgaaaagtttttcattgatcgaattcaagaaacatttccgggacatcggatactcggtgaagaggggcaaggagacaaaatccactcacttgagggagtcgtatggattattgatccgattgatgggacgatgaattttgtgcaccagcaaagaaattttgcgatttccattgggatttttgaaaacggtgaagggaaaatcggtttaatttatgatgtggtgcacgatgagctgtatcacgcatttagcggcagaggggcttatatgaatgaaacgaagctggctcctttaaaagaaaccgtcattgaagaagcgattcttgccattaatgcaacatgggtaacggaaaacagaagaattgatcaaagtgtgttagcgccacttgtgaaaagagtcagaggcacacgctcctacggttctgccgctttagagctggcaaatgtcgcggcaggaagaatagatgcttacatcacgatgcggcttgcgccatgggactacgcagccggctgtgtgctgttaaatgaagtaggaggcacctatacgaccattgaaggagagccgtttacctttttagaaaaccacagtgtgctagccggaaacccatctatacataaaacgatatttgaagagtatcttcatgctcggaagtaggccatttgagcaggatgatctcagcttgttagaaaagctcgcggaggctcatcctgtatggaaagaggaggagtttggagataaagatgcagaagactatatcatttcctactccatgtacaacggttcatggcttgtatgggaaaaagacggtatgcctgttgccgccagctaccatctcgagtggtctccttcaaacggtaagccgtggctcggaacggtcctgattgacccggctgaagaaaaaaagggacatgcgaagatgatcattgaacagatcagcaaattgcttagagcgaaacataaagcgatgtttgcgggagttcccattgagcgcagggaatggatactgtttttaagccaatgcggctttgaacagctgaaaacggaaaaagatgagaaaggcaaatcatttatgatcttggtgaagcctttagcagaagctgccgtatgataacgacagcttatttgctgcatgcgggttcaaataaaaagcctctcaaacattgagaggcttctgatgatttgaaaattatttttttaccgcatgaatataatgaatcgtttcaaacgctgacaaattgtcttttcgattactaaagaaaaggtcattgatgtcgtctggtgatagatgttcatagatcagtaaaccagatgactctaacagatgttcaatctcttgataagtgaaacatgatttcatcggttccccgcttgcggcagccatcttcaccatatgttcaactcgattcgacgtcccttttgctgtaaaaagtgtttcgtccgcataatcaaaaacaatagagcttccaggcgggacatcagaaaataaattgctgatcaaacttgcattttcttcccgtgttacataataagacactccgagaaggctgaagaatgtttttgtgttcttaaatccttcatctaagagagggtcatacgaaaacgttttggtgaaatccataggaacaaaatgaagatgacccggaattgtcaaatttgcatccttcagcttattttttttgaattgctgtgtagccggatgatcaacctcgaaaacctgtaagctattttctaattctggatgccgaaagcagaaagtatcaagccccgcgccaagaatgacatactgttttgctcccaggattaattcgttgtgcaagactttttcacaataagaagcacgtgctaggggcgtgggagacagctggatttgtgcaacccattttaatattttttcaggatcattttgaagacgttcgccgatctctttgttgaaaaacgatattccttgaatcatatttttactgatgtcgataaactctttctcgttaatgagatcttttgcgataaaatcatcaaaaataagaggtgtgtcatatcggctgtgatatgcacgggcaaaagctgaaattagagacgttaagctggactcatttttcctcatgaaatgatcctccacaaaaaataagattcccctggccaggagaatcttattatacatacaaatatattaatagtaaattttagcataaataattttttttgtcaatgtttttgcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctcaggcttttcctaatattacaatccaacagcattccaggctgcttcaactttagcggcatcagttgagccgtagaggtcacgggcagactgaatgagagctgccttggcatctttgaacgtggaagaaggcgtgaggtacgttgttaacgcacggtaatagatttgctgtgatttagatacaccaagttttgtgatggtgttgtaagcggctttgtttggaattccgctgtttgtgtgtacaccgccataatcgccttcatctgtgtttggaaggtttctgtaattggcgtaattgtcaggctggttgtattttgtagggttggacaggctgcgaagagcaggctggctgaccgtaatgtcttcaccgatgtcccagtcttctgtatcgttaaaatacccgaatacgtcagagaaagactcgtttaatgcacctggctgattttcataaatcaagttggctgtttcttgggtgacgccatgtgtcatttcatgcgctgtcacatctaatgagccggaaagcggcgagaagaatgaaccgtcgccatcaccgtaaatcatctggtctcctgtccatgcagcgttattgtattgagtgccgtagtgaacggaagaaacgattttactgcctctgttatcatagctgtttcgtttaaagtttgaataaaaataatcgtacactttaccgaggttatagtgtgcgtcaacggctgcccgctgtgatgaagatgtaaatgttttcgttgtgcttgagacaagcgtgcccggaaggcggctttgtctgttttgcaaatcatatgtgatgatttgggtgcctgttggttttgaaagatctcttagaacatattttccgccttcataagagatgttcaaaggaacagttgcgccctttagagttgttccgcttccagtggcggcggcatgttctactttattttgctgttttaaaatgctgccggtttcggcgtcaactaagacttcccagtttgcaggttcaggctcgacatagcgaatcgtcacgtcgtaagcaagacgatagctgccgtcctttgtttctatcgctttcaattcggctttattgctgtttttggccgctccgttagaaacagcgtctggtgatttgccgatagctttgaaagcgagtgccagagctttttcagaagagactttttggctgttatctgtttttgcagcagattgattgtgtaattcaccattgaccgcatagacattatcggatttatcgacgtgaacgatcacttgcgaatctttaattggcactccgttaacgacaggcgcatatcgaaagtgcttgtatccaagggcatcagtcgtgctttcaacaagcttcagccttttggaagggtcacctttaaaaatgttgctgttctttttcaaaaactgcttgacagccttgtcatttggtgcagagagttctgattgcgcaatcgcgtttttggagaggaaatttgtttgattctctttaagctgatgaccttcagcagcctgaacaccaggaaggctgattgataaactcataaacgaagcagcgacagcaacagacaatttcttacctaaacccacaataaatccccctttttgaaaatactgaaaactttatattgttatattaaactagcattctggaatactcaacaaaaactaacataactagacaaaattgatagtattgtcctgtgtttgtttttgttgaataatatcaagatgagtcaagtgtcatgtgacggttcactcaagagttatgttttttacatatcaaggggaagatgagatatttttgtttcaacttgaaactttttgaaaagtccgctgtctaaccgaatgaggccttaataagaagtaaaggattgttgttcgtgttggagttattcagtcattatgtattgcatttcgaacgttattttatattaagcagacaaagcaccctgctgattcaatggtcaattgttgttctggcgggcttatatcttttggtgcatcatcccaaaataaaccggcagcgcacaatgttcttggcgggtgttatgttgcggattgtgctgctggcgggagtgtctgttgaacttattcaccaggtgcaatcaacaaacttcaccagcgcttacttaagagaggacggaaaagaactgttgccgctgctgcattttttgttatacggatatgtgctgctgacggcttttcactatatgctgatgccgcgtgatcatggcggaaagggtaagttttatacgttcgaccttgccgttgtcagtttgccaatcgtacaaatgatattcagtttctttacgtattggaaggaaaatccgggcggagtcgagccaattgcattcgtgtttttgtttttcattattactcttcctattgtgttgaatgttgtgtttttcaagctgtattggagaacggataagatcttactaggcttattttatacgctgattatcggactgcttgtcttgctgcttgcgccatatcccgatcaaatctcaaaaaattatggtgcagtaatgccatatacgatttatttggcaatgacgggatttttgatgagctatcatctgttccaaaagtcaggaaaggtttatgtgcgtgtgaataagtggctgccgatggctgtcatggtgttttttgtcctgctgttaaatccgatatataacataggaacggctgctttcgctgtatcaaagccagcaaatgtccatgattcattcaattttgtcggggagcacatttcatcagaaaaagcggaacagatactaaagtcattttttcctacggatgaaacactttatttgcacgatacaaacatggatgtgcattatttctactcatttgaaagcaaaggttataaagctgaggtagatgaagtatcgcagctgattcgtaattatgaatacttacaaaaagcgcatgggaaaaagctaacgaatcaggagtacaagcgaaagtccatcgctttccttgagcgacacggacgtgtgttacataaggatcatatcgaaacaaaggtatctcaagaagacggccagacagtcgtacgtatttacctgaaaaatcaacttcataaaaaagatcctgctgatgatggcacggtattttattgggaaaaggaaaccttaatggggtttagtgaagatccttcgatttatcagcttgactctcttctgcatgttcatataacagaacaagacattcatgacaaagtggaacaaatgtttacagcactgaacatatcaaaacagccttatcagatcactgatattgaaagcgacagcctgctcggaagcatggtgagagttgaaacaaaaggtggaattgttttggaatttgagggcgaatccggttgtttacatagtctttcgcttccgatgaaaaagaatatctcaatggctaacagccggctgcagcatcagatattatcgatcttcgatgctcgtggatcagaaaagaagaaaaaaagcagtcagggtgacatggtgatgtatactgattcttctaaaacatatgagttttttgaagatcaaggtcagctaaacgtttatgtatacagcgatacacctgatcagtcattcccctatacatatcgtaatggaacattggcttacgaaaaagtagcttctctatatcaggatgtcatttacaaaaagcgtatgcgcccgattatcgttcaaagaggggatgaacggcattatgcatggctgatcattattcagccgtttggttcaaatcgccatgatgcctatgtagtggatggagaaacacaagaggtgaaaagtctttatgaatcataaagaaaaagagtctgtttttgtagacctatacgacctgtataaagaaggagagctagaggatgaatcaatggaatggatgaaacagcatgaatcccaattccaaaagaatgcggaagacttaaagagtaaaacttgtttaaagagaagtcccggtgctgaagaagaaagccaaatcagatatatgaaagtatacctgtcttccatgtatatctgtttcattttattggccatttggatgacggtgtggttttacttttaatgaagcatagggattccattgaggacttgtatcgacagtattatcaagaaattttaaattatttattcagaaggactcatcatcttgaaacagccaaggacttagcgcaggacacgtttgtgaaagctcttaacggtctggcttcgtttagggggcattcttccatcagaacatggctctacaccattgcgcatcatacctttatcaattggtaccgcagggatgtcaaataccaatttactgatatcagcaaaaatgaagggttaacgcaaacaacttatgagcagcctgaacagtatctgtcacggacggtgaaaagcgaaacactgcggcaggagctcctgaagttaaaaaatcagcatcaatccgttttgattttaagagaattccaagagctttcttatgaagaaatcgctgagatattaggatggagtctttctaaggtgaaaaccacattgcaccgggctagattagagctaaagaaaaacatgacgaaaaatagagaggaggagcggatatgacctgctttctagtaagagacctgcttcctctgtatcttgaaggtgattgtaaaagagaaacggaacacgttatagaagagcatttaaaaatgtgcagcagctgcaaagacatgtatgacacgatggctgagccatttgaattggaaagtgagcaggccgttgaggaggcttatctgccggaagaagaactgcgttttaaacagaggtactatggattacttatcatgaaagctgcctgctggtttggagcggcggttgccatgatgctgatcatcaaactgctgatataaaaaaagcgcttgtccgattccggcaagcgcttttttacattaagcctggggatgaatcatatcgtaaatagcggcaagctgttcttgtgacagggcactgaagagtttttcataaacgtcagcttgcagtggcgttgcacctgcttgtagcgctgcgtctttatcatagctgtacacatcatcttgtagcacaatggctgcttgaagaatgtgaatcttgagagaaacagcggagaaaaattgttcaagtgcaagtgcttctttttctgtgaagccaagttcaactgctttttctgtatcaaatttgtaatttccatcctcgagatacacacattgtgaaacaatgctgaaaaattctgatgtcgattcccagagtgtagcaattacctgagcctcttcttttgtcattcctaactcgacagctttttcgctgtcaaaataatatacaccgtcttgttcgtaaatacattgatttaatatatcaatgaatgtattgagatcttcgttagtgctcgcctgatgctggagttgaacagcagtgttatcaaccggtgtttttgcgctggctgcatcaggaccgaacgttaatagagcagctgaggtcattgcggcagtcgttaacatagctttttttacaaatgttttcttcatgtttcttctctcccttttatgaattgtgctacaaattccattatagggagtagtttccggtgaaggaataggcgctatggtattttatgtgtatcgttgccgaactactttttgaaggctgcacgtgtgatcgttagaacgattgtctatgtatgaaggctgttttgcatcttcctgactaagaaacaggggagataaggcttaaagaaatgaaaaacaccgctttctttgcggtgttttttgattacaatgtcgccggcggggcaatgcttttaatcaagcaagccttgttcgcgcattttcttttttaatgtaaatccgccgcccatgacagcgcaaacaagtacaatgctggcgataatgcctgcagggcttttttcagcgataaagacgccgatcagcataatgctgaaaaccgctgcaaatgcaaataatagtaaaagccaattcatttttttcataaattccatccccttttacgtcttatattaagtttacagaaaaacgtgacgcttttaaagaggatgtgtgatataatatgaaagttatctaatttttttaggagatgaaaaagtgaaacttcgaaatgatcttcgcaacatcgcgattattgcccacgttgaccatgggaaaacgactctagtcgatcagcttttacatcaggctggtacgttccgtgccaacgaacaggttgctgaacgcgcaatggactctaatgatcttgaacgcgaacgcggcattacaatattggcgaaaaatactgcgattaactataaagatacacgtatcaatattttggacacccctggacacgcagactttgggggagaagtagaacggattatgaaaatggttgacggcgtagtgcttgtcgttgacgcatatgaaggctgtatgcctcaaactcgttttgttctgaaaaaagctcttgagcaaaacctgaaccctgttgttgttgtaaacaaaattgaccgtgactttgctcgtccagaggaagttatcgatgaagttctggatctgttcattgagcttgatgctaatgaagagcagctcgagttcccagtggtatatgcttccgcgattaatggaacagcgagtcttgatccgaaacaacaggatgaaaacatggaagctttatatgaaaccattattaagcatgtcccggcacctgttgataatgcagaggagccgcttcaattccaagttgcccttcttgactacaacgactatgtaggccgtatcggaatcggacgcgtattccgcggcacaatgaaagtcggacagcaggtttctcttatgaagcttgacggaacggcaaagtcattccgtgttacaaagatttttggtttccaaggcttaaagcgtgtggaaattgaagaagcaaaagcgggagacctcgttgcggtttccgggatggaagatatcaacgttggtgaaacggtatgtcctgtagaccatcaagatccgcttccggtgcttcgcattgatgagccgacacttcaaatgacatttgtcgtgaataacagtccgtttgcaggccgtgaaggcaaatatgtaacggcccgcaaaatcgaagagcgtcttcaatcacagcttcagacggatgtgagcttgcgtgttgagccgacagcttctcctgatgcttgggttgtttcaggacgcggtgaactgcacttgtcaattttaattgaaaatatgcgtcgtgagggctatgagcttcaagtgtcaaaacctgaagttattatcaaagaaatcgacggcgtacgctgtgagcctgttgaacgtgtgcaaattgatgttcctgaagagcatactggctctgtcatggaatcaatgggtgcccgcaaaggcgaaatggttgatatgatcaacaacggaaatggccaagtccgtctcatctttacagttccttcccgcggattgatcggttactctacagaattcctatcattaacacgcggattcggtattttgaaccatacgtttgacagctaccagccgatgcaggcaggccaagtcggcggacgccgtcaaggtgtacttgtgtcaatggaaaacggaaaagcaacatcatacggtattcaaggaattgaagaccgcggtgtcatcttcgttgagccgggtactgaagtatacgaaggaatgatcgttggagagcataaccgtgataatgaccttgttgttaacgtcagcaaaatgaaacagcaaacaaacgtccgttccgcgacaaaggatcagacaactacaattaaaaaagcgcgcatcatgtctcttgaggagtctctagagtacttaaacgaagatgaatattgtgaagtaacacctgaatccatccgtttaagaaagaagatcctcaataagaacgaacgtgaaaaagcagctaaaaagaaaaaaacagcaggattgtcttaatctcgtgcagaatttgaaaagatagaacccgtacgtttacaggggagggaatctttttgaatgacgtaagcgaacgcctgtcgttcttcgccgctctatatcaagtagaccggcagcctgcggcaggcatgtggctgctgtacggcacgatttttgtgttggccgttattgtatttaagcttggatttgctaaacggcttcctgtattaaaatctgcagtggtgtatgtatttttggcgttgggctgcactgttttgacttttttaggggtgtttttgcccgtggcagaaggattgatcgtcgctgcgctgattttaatcatttacaaaattcggctgtatcagtcgaaaaaaggacagtctgcaaaatcataaaagactcagctgaaagctgagtcttttttgtgttctgtatggttaagcggacgctttattttttgactttttcttttttctgctgtcccgggtgaaaagtaaattttcccgttttcagccgttcctctgtttttttggcaatccgatcgtggcattcctggcacatatatgtatggatcgggcggtttcgaagccgtttcgcgatcagggtatcatcatcaattgtttcaattttatcgcaaatagaacatttgaccctcatcatatcacctctttcactaacatgtattatagcacggatcagaagctgtccaaaataagaaaaagctaaagcgcaaggctatagcttagtcattgttgttctttttcatatgatgatcagattgatcgttttgctccttctccatttcctgctgctgttttctatttaattggtcattttgctgctttgtttgcggttcgtcttcattgtcaatcacatcgttaggcacttcgggaagcactcggccgacaattgcagctaattcatccagtatgcctgttaccggacggccctcgctgatttctctgctcatttcgcgaaggcggctgaccgtatcgggatcagcaatgactactgcgttggcgccatatcgatcattctttagcgcctgagctacagaatatttaatggtttccactttgcttctgtccaaagtatcatcgacatcaatcccaacaacagcataacctcccagcacaacggctgttgcatccttgacgtcggggtttttttcagcaacgctgacaagatgtttggcaatatccgttcttgttccattgttttttgtttcttgagttgtgtcctttacgtgaatcggtttagtctcctgctgtcttgttgattctttttcaacattctggccctgttttccttgttgataggcacaagcggacaggataagtgtcagctgtatgataatgaaaagaattcgcacttgcgggttccctccttaaaatgctttcattaattttattgttgaattaaccttctatctttatgcacaaaaacatatattttagcaggcattcatctttttcatcaaaagagaagcaggaagaactttgacccttatatcaggaggctgagacttgagtaaaatttatgtgttagatacgaatgtgttattacaggatcctaacgcgatattttcttttgaagaaaatgaggttgtcatccctgctgtcgttttagaagaggttgattcaaaaaaacggtatatggacgaagttgggaggaatgcaaggcacgtatctaagctaatcgatgcgctaagacaaaagggcaggctgcatgagcatgtcccgcttgacaccggcggcacactgagaattgaactgaatcatcgttcgtttcaccagctgcaagagatctttattgaaaagacgaacgataatcgcatattagccgttgcgaaaaacttgagcctcgaggaagaaaccaaggaaaatggcaggccggttatcctcgtcagtaaggatgtactggtcagggttaaagccgacgcaatcggactgcttgctgaagatttcttgaatgaccgggttgtggacaatgatgaaatgtacagcggctataaagatttatatatcagtcagcagctgttcagctctttttacggaaaaaatcaaatttcagtaaacgatgtgaaacagcatgcgttttatccgaatcagtttgctttaatgaaggatgagctaggaggatcctcctcggcagtcggaattgcagataaaaccggaacggtattaaaaagactcgtatttgatgatgaacatatatggggaatcaggccgaaaaatgtacagcagacaatggcattagagcttttgctgcgggaagatattccgcttgtcaccctgatcggcaaagcgggaaccggcaaaacgctcttagctttggcggcagggctattacagacagaagacttgggaatatacaaaaagctggtcgtcgcaaggccgattgttcctgttggcaaggacatcggatatttgccaggcgaaaaagaggaaaagctaaagccttggatgcagccgatttttgacaacttagagtttctgtttaatgcgaaaaaaccaggggagcttgatgctattttggcgggaattggctcaattcaggtagaggcgctgacttatatcagagggagaagcattccagatcaatttattatcattgatgaagcgcaaaatttgaccaggcatgaggtgaaaactttgctgacgagagtcggtgaaggcagtaaaattgtcttaatgggcgatcctgaacaaattgatcacccatatttagacagtctgaacaatggtttggcctatgtggttgagcggtttaaaggacaacccatctcaggcagcgtgaagctgttaaaaggtgagagatcaggtctcgcccagctcgcagctgatttgctgtaacattaaatgatttcgatctcttttacatcggtaatcggctgtttgtgatggaccggaccttcaaagtaaatatgcacggggccgccttcttgaatcggtttgcctgcctcactgaaatggacaatactgttcagagcggtttccagagaaacggcggcctttcccgaacttgtgacaaatacacattgtgtcgcagagctgttcggctcagcatttttcaggacagtcccaagtctcattgcgaaactgccgttcatcagtttttgcttctcatattgtttttccgtctttaatgtaggcggcgcaattcgcccctctctgatgacgcgttccggatcaaggtcggattcatccccggctgattgtaaatatgtgtcttgactgtcccctttgcggtcaaacgaaaatttgcgatcatcaaaaatccatacgcttggatcaatggtaattggatatgtaacattgccttttacttggataacgctcatgatatgacccccttctctcaaaattataaaagttttcgcatgaattgtcactttgtgtacaaattatgtgtattgaaatgctgagggaacgagggtgtttgcatggtatgccggcataatgatgagcttgaagccttagtgaaaaaggcgaaaaaagtaacggacaagggggaggtagccagctatattcccgccttggcaaaagctgataaacacgacctgtcagtggcgatttattattccaataatgtttgtctgtcagcaggtgacgtagaaaaaacatttacgcttcaaagtatatcgaaagtcctttcccttgctttggtgttaatggaatacggcaaagataaggtcttcagttatgttggacaggagccgaccggtgatccgtttaattcaattatcaagctcgaaacggtgaatccgagcaagccgttaaaccctatgattaatgccggggcattggtagtgacaagtctgataagaggaagaacggtgaaagagagacttgattatttgctttcttttatcagaaggctgacaaacaaccaagagattacatactgccgggaagtggctgaatctgaatacagcacttcaatgattaatcgggcgatgtgttattatatgaagcagcacggcatttttgaagatgatgtagaagcagtaatggatttatacacgaagcaatgcgcgattgagatgaacagcttggatttagcgaaaatcggatctgtatttgcattgaacggcagacatccagagactggggagcaagtcatctcaaaagatgtcgctagaatttgcaaaacgtttatggtgacgtgcggaatgtacaatgcaagcggggaattcgcaattaaggtcggaattcctgcgaaaagcggcgtatccggcgggattatgggcatttcgccttacgatttcgggatcggcatattcggccccgcattagacgaaaaagggaacagcattgcaggtgtaaagcttttggaaataatgtctgagatgtacaggctgagtattttttaatttatgtcatatgcttaaatcctcttgcattttctgttgataccctttatgataaatagaagaattaggtactcgcctggggaacggagggatacttttggcttcagagatgatagttgaccatcggcaaaaagcttttgaactcttaaaagtggacgctgagaagattttgaagctgatccgagtacaaatggataacttaacgatgcctcaatgtcctctatatgaagaggttttagatactcaaatgttcgggctttcgagggaaatcgattttgctgtccgcctgggattggttgatgaaaaagacggtaaagaccttttatacacattggaacgcgaattgtctgctttacatgacgcgtttacagctaaataaatgataaaactcaaacttattaacagtttgggtttttttataaccgctatttttctctcatctcataaaagacggactttttttacacattccttccgaatcgtatagagattcttcgtctcgtttgataaattgtagtaaaataaaaaagataaatacataaaaaccatagataatgaaagttagaagcagggaagaggatgttatgttaaaaaaaatgctaaaatcttatgattactcactgatattcgcaatcgttttattatgcggattcggtttagtgatggtatacagctcaagcatgattacagctgtctcccggtatggagtaagcagtaattttttcttcatgcggcagctgtttgctttaattgcgggtggcgctctatttattctcatggcgttgtttccttacaaggcactggcccatcaaaagtttcagaaagggatactgcttgtatctgttcttgcgcttatctcactgtttgttttcgggcatgttgccggaaacgcgcagagctggtttaaaatcggcggaatgagtattcagcctggggagtttgtgaaactggtcgtgattttataccttgcagccgtatatgcaaaaaaacaaagttatatcgaccatctgttaacgggagtagcccctccggtagtcatgacgcttataatttgcgggttaattgccatgcagccagatttcggtacagccatgattatagggttaattgcgacgtgcatgatcttgtgctccggattcagcggaaagacgctggtgaggctgcttttgctcggcggaattgttttcattttagtcagcccgattctctatttaaatcaggatcaaattttaactaaaggccgtttggcgcgttttgagagtcttgaagacccatttaagtatgcaaattcatcaggtttgcaagtgatcaattcttattatgcgatcagctcaggcggcattttcggcctggggctcggtgaaagtatccaaaaatacggatatctgcctgaatcacacactgactttattatggctgtcattgctgaagagctcggcatttttggggtattgtttgtgattttcttattgggttttgtcgtcataaaaggtttttatattgccagaaaatgtgaggacccgtttggaagtcttctggcgatcggcatttcaagcatgattgccatccagtcgtttattaaccttggcggtgtcagcggattaattccgattacaggggttacgctgccatttatcagttacgggggctcttctttggtgctgctgctggggagtatggggatattagcgaatatcagcatgtttgtgaaatattcagagaataagaaaaagaaagagcccttggcgccgaagggaatgaaaaagaaacagctcaaaaaaactgtttatctgtaaaaaacaagtgtgtacaggggaaggatattccgctatgatagattatattccattcgggtaagggggagaaaagtttgtctcagcaatcgatacaaaaagtattagtagcaaacaggggagaaattgcaatccgaatattccgggcgtgtaccgagttgaatattcgaacagttgcggtctattcaaaagaagattccggttcctaccatcggtacaaagcggatgaagcatacttggtcggtgaagggaaaaaaccgattgatgcttacctggatattgaaggtatcattgatattgcgaaaagaaacaaagtcgatgcaattcatccgggatacggtttcttatctgaaaatattcattttgcgagacgatgtgaagaagaaggcatcgtattcattggtccaaaatccgagcatctcgatatgtttggtgacaaggtaaaagcgcgtgagcaggcagaaaaagcgggaatccccgtgattccgggaagcgacggtcctgccgaaacgcttgaagccgtcgaacaatttggacaagctaacggttatccgatcatcattaaagcctcgcttggcggcggcggccgtggtatgcggattgtcagatctgaaagtgaagttaaagaagcatatgagcgtgctaaatcagaggcgaaagcagcctttggcaatgatgaagtttatgtagaaaaattaattgagaatccgaaacatattgaggttcaggtcattggagacaagcagggaaatgtcgtccatctttttgagagggattgctccgttcaaagacgccatcaaaaagtcattgaagtggcgccgagtgtctcgctgtcacctgaattaagggaccaaatttgtgaggcggcagttgcgcttgccaaaaatgtaaactatataaatgcggggacggtcgaattccttgttgcaaacaacgagttctactttattgaagtaaaccctcgcgtacaagttgaacacacgataacagaaatgattactggtgtcgatattgttcaaactcagatccttgttgcccaagggcacagccttcacagcaaaaaagtaaatattcctgagcaaaaggacatttttacaatcggctatgccattcagtcacgggttacgactgaggatccgcaaaatgatttcatgcctgatacaggaaaaatcatggcttaccgctcaggcggcggttttggtgtccgtcttgataccggaaacagcttccagggcgccgtgatcacaccttactatgattcacttctcgttaagctttcaacttgggctttaacgtttgaacaggcagctgccaaaatggtgcgaaaccttcaggagtttagaatcagaggcataaaaacgaacattccattccttgagaacgttgcaaaacatgagaagttcctgacagggcaatatgatacatctttcattgatacaacgcctgaattatttaatttccctaaacaaaaagaccgcggaacgaaaatgctcacttacatcggcaatgtgacagtaaacggtttccccggaatcgggaaaaaagaaaaaccggcgtttgacaaaccgttaagcgtaaaagtagacgttgatcagcagcctgccaaaggaacaaagcaaattctcgatgaaaaaggcgcagaagggcttgcaaattgggttaaggagcagaaatctgtccttttaactgatacgacattcagggatgcccaccaatcgttattggcaactagaatcagatcgcatgatttgaaaaaaatcgcaaatccgacggctgcgttatggcctgaactattcagtatggaaatgtggggaggcgcgaccttcgatgtagcctaccgattcctgaaagaagatccgtggaagcgtttggaagatcttcgcaaagaagtgccgaataccttattccagatgctgctacgctcatcaaatgcggtcggctatacgaattatccggacaatgtgattaaagaatttgtgaagcaatcagctcaatccggtattgatgtgtttcgtattttcgacagcttaaactgggtaaaagggatgacgttagccattgatgctgttagggataccggcaaagtggcagaagctgcgatttgttatacgggagatatccttgacaagaaccggacgaagtacgaccttgcatattatacatcgatggcgaaggagcttgaggcggccggagcccatattctcgggattaaagatatggcagggctgttaaaaccgcaggctgcatatgagctcgtttctgcgttgaaagaaacgatcgacattccggttcaccttcatacgcatgatacgagcggaaacggtatttatatgtatgcgaaatctgttgaagccggcgttgatatcatagacgtggcggtcagctcaatggcgggattaacgtcacagcctagcgcgagcggattttatcatgcgatggaaggcaacgaccgccgtccggaaatgaatgtccaaggcgttgaattgctgtcccaatattgggagtcggtgcgtaaatattatagtgaatttgaaagcggaatgaagtctccgcatactgaaatttatgaacacgaaatgccagggggccaatacagcaacctgcagcagcaagccaagggagtaggccttggcgaccgctggaacgaagtcaaggaaatgtacagacgcgtgaacgatatgttcggtgacatcgtcaaggtaacgccttcctcaaaagtagtcggagatatggcactctacatggtgcaaaacaatctgactgaaaaagacgtttacgaaaaaggtgaatctttagatttccctgattctgtcgtggagctttttaaaggaaatatcggccagcctcatggcggattcccagaaaaactgcaaaagctgatcttaaaagggcaggagccgattacagtcagaccgggcgaactgcttgagccggtgtcatttgaagcgatcaaacaggaatttaaagagcagcataacttggaaatttcagatcaggatgctgtggcatatgccctttatcctaaagtcttcattgattatgtgaaaacgacagaaagctatggagacatctcggtattagatacaccgacattcttctacggtatgacattaggtgaagagatagaagttgaaattgagcgcggcaaaacgctgatcgttaagctgatttcaatcggtgagcctcagcctgatgccacccgcgtcgtttatttcgaactcaacgggcagccgcgtgaagtagtcattaaagatgaaagcattaagtcttccgttcaggaaaggctgaaagcagaccggacaaatccaagccacatcgcagcttccatgcctggaacagttattaaggtattggctgaagcaggcacaaaagtcaataaaggtgatcatttgatgattaatgaagcgatgaaaatggaaacaacggttcaggcgcctttctcaggaacaatcaagcaggttcatgtgaaaaatggtgagccgatccaaacgggagatctgctccttgaaattgaaaaagcataaaaaacaaagagtgtatatcatttgatatacactcttgttttttatatagaaaatgtggagtgaaacagatggttagaagagatataaggggacttcagagattatagagtactgtcacaagcccaaaataaaaagaggcttatataccaccaattttttagatgctttgtagtagtccatgcatatttctttaagcactatctgattttccaatggccaaaaggctttaatacttatgttcgcggactatagatgcatatgaaatttctataatcacgatgagaaaggggacaggccgaagtgagccgctcactgatcatcaagttcagcgaaggctggccattgaaacaataaagcgccaaaacaagacatgaaaaaagaccaaagccgcctaaggctttggtcttgagtccttatgattgcctggattcgtaacggaaacgagcaatcaataataagaagtagcatagaacgccaaacagacaggcaataaagaacgagtgggcaagtgcaaagcccagagccagttcagagtatacgatcataatcccggacagtgcctgtaatgtaatgaaaataagacatgagatccatccccaaaagatctgtttttgatctttataggagataatagcatgaacagcggcaacaataatccatacaaataacagtaaggctgctgctctgtggcccatttgcacccattcatggaattgggtcggaagtccattgttcagcgggctgcacagcggcacatcaggacatgccagacttgattcagtgtgtcttacatatgcgcctgtatacacaacgatataggaatatattaaaattcctatcatgtgaaattgcatctttttgccgatttgaagcggcttaaccagtgttctgactgatttatcagcttcaaatatgagcaatgtcaaaataagcactgaagcaaaagaaattaatgagatgccgaagtgaagcgccataatcagcgcgttcgaaccgaatacgacagccaatgcgccaagcaatgcctgaagaaataaaaagataattgacatgatcgcgagaaacgttgtttcacggaaaatcggcgtgatttttctccatgaccaaaacgcaaggcttagcacaaggataatagagattccgcttgcgaatcggtggctccattcaataattgaagccggattcagttcagggaaaaaacggccgtgacacagcggccactgtctgccgcatccttggccggaacctgtttttgtaacgagggcacccccgattaaaacaattagcatgacaaatgtcgtcagaacaccgagagcttttaatgctttattcatacaatattcaccttctcaacatactgctgcaattttatatacgttccaagtgtaagcgaatatgtgttttgtggcaattcccagagccttttgttcacaaaaatataatagaatgacggcttctggaaaatgtacacttgattattcatgccgggtctgatagaaataaggtaaacgcaatgccgatttggagattgccttcatctttggtaaaattcataaaaagttcacaaataaattcctgtttgtcgtttaatatttaataggatgtttttttacaagatgttatcttgtatgatagagttgcaggttattttattctcctgcgttaggtttgtaagggaggtttacgttatggctaactccagaatcttaaatgatacagctatagacggacaaattgaagaaacaacggcatggaaagattttctgtcccttattaaaatagggatcgtcaattctaacctcatcacgactttcactggaatgtggcttgcactgcatatatccggtttaagttttttaggcaatataaacaccgttcttcttacgttaatcgggtcttcactgattattgcgggctcctgcgcgatcaataactggtatgaccgggacattgaccatcttatggagcgtacgaaagtaagaccgacggttacgggtaaaattcagccgagtcaggcgttatggtctggaattttgctggttgctttaggattgatcatgctgctgatgacaactgtcatggctgctgttatcggttttatcggagtctttacgtatgttgtattgtacacaatgtggacgaaacgccgctatacgattaacacagtagtaggaagcgtttccggtgcagtgccgccgcttattggatggacggcagtggaagggaatatcggtgtcgtagcatgggtgttattcatgattttatttatttggcagattcctcacttcttagcattggctattaagaaaactgaggattacagagctgcaaatattccgatgcttcctgtcgtatacggatttgaagtgacaaaaagacaaattattgtgtgggttgcatgcctgatgccgcttccgtttttccttggtagcctgggtcttccgattgtcattctcggcttgctgttaaatatcggctggctgattcttggcttaatgggattccgctccaagaatatcatgaagtgggcaacgcagatgttcgtttactcgcttaactacatgacaatctatttcgttgccatggttgtcttgacgcttttctaaaaaatagatatgatgcttgttttatcgcttcaaaataaacgatgacaactagtaaatgccgccttgacctcttgtttaatcaggcggctttacttttatacatagatggcattttgagtaaaaaaactcataatttaagagaagaggaaatgtaagtgctttattggtgataggttggatggcgatagatttcgatccgctttccgcctttgtattgaccagaaaaggggttgggtgaaatggtaaagcattggcgtcttattttattattagccttagtgccgcttctattaagcggatgtggaaaaccttttttatccacgctcaagcctgctggcgaggtggctgataaacagtatgacctgacagtgctcagcacattgattatggtggttgttgttgcagtagtatctgttatcttcttttatgtgattgtgagattcagaagatcacgggtcggtgagaacacgataccgaaacaggtagaggggaataaatttttagaaatcacatggaccgtgatcccgattttgctgctcattattcttgtgattcctgttgtattatatacgctggagctagcggacacatcaccaatggataaaaaaggccgcaaagctgaggatgctcttgtagtcaatgttagggcaaatttatactggtgggagtttgagtaccctgattacggcattatcacaagccaggagctgattgtaccgacagatcagcgtgtatattttaatttaaaagcctctgatgtaaaacattccttctggattccttcagttggaggaaaacttgatacgaatacggataatgaaaataagttcttcctgacatttgattcaaaacgaagcaaagaggcaggagatatgttttttgggaagtgtgcagagctttgcggcccttcacatgcgctgatggattttaaggtgaagacgatgtctgcaaaagaatttcagggctggacaaaagaaatgaagaactataagtctacagcagagagcgatttggctaagcagggtgaagaactgtttaaagagaaaaactgcctgagctgccatgcggtagagccgaatgataagcgtgcagaagccgctagaacggcacctaacttggcgaccttcggtgaaaggacaaaagtggcaggggtgaaagaggccaacaaagaaaatgtgaaggcttggctgaaggaccctgacagcataaagccggggaacaaaatgacaggcacatatccaaagctctcagacagcgaaacagatgcgctttatgaatacttaaaaggcttaaaagcggaaagcaagtagggaagaaagggagatattgggggaggtcacatatgttgaatgcgcttacagaaaagcggacgcgcggatctatgctttgggattatttgacgacggtggaccataaaaaaatcgcgattctttatttagtagcagggggattcttctttcttgtcgggggaattgaagcgatgtttatcagaattcagcttgcaaagccggaaaatgcgtttctcagtgctcaagcgtacaatgaagtaatgactatgcacggaacgacgatgatctttctggctgcgatgccgctcttatttgccttgatgaatgcggttgtgcctttgcagatcggggctcgggacgtttcgtttccatttttaaacgcgcttggtttttggctcttctttttcgggggcattttcttaaatctaagctggtttttgggcggagcgccagatgcgggctggacgtcatatgcctcactttcgcttcattctaaagggcacggcatagactttttcgtcctcggactccaaatatcggggctcgggacgctgatagccgggattaactttttggccacgattatcaacatgagggctccgggcatgacgtatatgaggctgcctttgtttacatggacgacatttgtggcctcggcattgattttgttcgcgtttccgccgcttacggttggattggctctcatgatgctggatcggctgttcggaaccaatttctttaatccggagcttggcggaaatacggtcatttgggaacatttattttggatcttcggccacccggaggtttatatcctaattttgcctgcattcggtattttttctgaggtcatccctgtgttcgccagaaagcgtttgtttggctattcttcaatggtttttgcaatcgtgctcattggctttctgggctttatggtttgggtgcaccacatgttcacgactggtctcggcccgattgcaaatgcgatttttgcggttgcaacaatggctatcgcgattccgaccgggattaagatttttaactggctgttgacgatttggggaggaaatgtgaagtatacaaccgctatgctgtatgctgtctcatttattccatcctttgtgctcggcggtgtgacgggagtcatgctggcagcagcagcagctgattatcagttccatgatacgtattttgtggttgcgcacttccactacgtcattattggcggtgttgtattcggccttttagccggtgttcatttctggtggccgaaaatgttcggtaaaattctgcatgaaacgatggggaaaatttcatttgtattgttttttatcggctttcacctcacgtttttcattcagcattttgtcggcttaatggggatgccgcgccgggtttatacgtttttgccaggacagggtctggaaaccggcaacttgatcagtacaatcggggcgttttttatggcggcagctgttattcttctgctggtcaatgtcatatggacatcgataaaaggtgaatatgtaggtgctgatccatggcatgacggacgtacgctggaatggaccgtttcttcaccgccgccggagtataactttaaacagcttccttttgtcagaggacttgatccgttttggattgagaagcaggcagggcacaaatcaatgacgccggcggaaccggttgatgatattcatatgccaaacggctcaatcctgccgctcatcatttccttcggcctttttgtcgcagcgttcgggctgctgtacagaagtgattacgcttggggtctgccggtgatctttatcgggctcggcatcacatttattacgatgctgcttcgttcagtaattgatgatcacggctatcatattcataaagaggaactgccgaacgatgataaaggggtgaaggcataatgcaagttcaagaaaaattcaccgcagaaacctttccagcttctcctgaaaaagtaaccctggaagggaaaaataaatttttaggcttttggctttttcttggcggagagactgttctgtttgcgtctctcttcgccacgtttcttgcgctccggaattcaaatgccggtgatccgcctacgacggaaatgttcgatgtgacacttgtattcattgccacaatgcttctattaacgagcagtttaacgagtgtgtacgcgatgtaccacatgaagaacttttccttcggcaagatgcagctttggctgggaattacgattttattgggggcgggctttttaggactggaaatctatgagttcaagcattacacccatgaatttggctttaccatcacaagctctgcccttggttctgcgttttacacgcttgtcggtacacacggcgcccacgtggcatttgggcttatgtggatcagcacgcttatgatccgcaatgccaagagagggctgaatctgtatacggcgcctaagttttacgttgccagcctttattggcactttattgatgtcgtgtgggtcttcatctttaccgttgtatatttaatggggatggtgggataaacatggtcgataaaaaaagcagagggcatatcaatagcgaccttgaatttaagaaaaaaaagcatgcccgagagatgaaatatcaagtcctgtcttttggtttaatgatcggtcttacgattgttgcatttctgactgtggccacggacggtgtcggcagctggtttacgattcctttcattattttgctagctgcaattcaagtcatctttcagctgtattatttcatgcatatgaatcagaaagggcatgaggcgccggcactgtttttgtattcaggggtgtttgtcgcgtttatcactgtgcttgcgtttgtgacaattatatggtggtaatttgaaacagccgccggaggtgaagaaatgaatcagttggagatattcgggtttcgcgcgatgtggagcccttatcttttttgtatcctgttaggcattacggcgctttatctctatttttacaggcgaatgtcttcaaagccaaatcgaataactggtaaagagatggtatgctttctgtcggcgatgctgtttttatatgcagccgagggaagcccggttgatctgctcggacatattatgttcagcgcacatatggtgcagatggccgtcctgtatttggttgtcccgcctctgttaatcgcgggaattcctgcatggctctgggaaaaaatcattttcaggccttcaatcaaaccgtttttttccttttttacgacgcctttaattgctttgcttttgtttaacggcattttttctttatatcatgtaccgcttatatttgatactgtcaaaacggatccgttttaccatacattaatcacttggcttatctttgtgcttgcgttcttcatgtggtggccgcttgttcataaggttgagcgtctacggcagctcagcggcttgatgaagctgggttatattatggcggacggtatgctgctcacacctgcttgcgccttgatcatgttcagcggtgcaccgttatacgccacctatacagatccggctttatgggctgaggcaatgaggctttgtgtgccagcggatatgatggggcaggtcccattaacagggccagagatgttgaatacactgcctttgttagaggatcagcagctcggagcagtcatgatgaaaatcattcaggaaattgtgtacggtacttttttggccattatttttttccaatgggtgaagaaagaaagggaaaaggacgggcaggaggagccgccgtatattcagcagacgatatcataaaaggtacagcgaaatatgctgtaccttttcgttacatttgaactgtttttaacatgttggctatgtcctgaatcagtgccttgctttttgtcacaacctgtacgggaaactcttccgtttctccatattctactccatgagggtaataatgctttcctaggagaggggacattaattgaatcacggcgcgcccgcttccgacatcgccttctgccgcaataccttgtatccgcaggtaaaacgtaccctcaatcgtcgaaaacttcttgtcataggtgactctctcgtaatcccattgacccgctctgataagacctttgctttccattaagtcgtctagccagctgagctcagccttaaccccttcaagtccgctttcagtaaacttcaacactgacccctccttataaaaattacctttcctgacaatcatagtatgaaagcgttaaactttcaatgaatcttcttcttttgaaagtatgcaaaaattaaattttgacgacaatagcactagactaaaggaggttaaacggatgacaaaaataaaagatctgatgacagccgacttgcaatattgcacggtattagataatgtatatgaagctgcagtaaagatgaaggacgcaaatgtaggagcgattccggtagttgatgaggacggggaaacattggtcggcatcgtaaccgaccgcgatctcgtattaagaggaatcgccatcaaaaaaccgaactcgcaaaaaatcactgacgcgatgactgaaaaacctgtcagtgtggaggaagatgcttcagtcgatgaggttcttcatttgatggcatcgcatcagctcagaaggataccagttacaaaaaataaaaaactgactggaattgtcacgcttggtgatatttctttatctgagcaaacgaatgaacgtgccggcagcgccttatcggatatttccgaaggtgataatagagaagaaggcttttttcattaacacataaatctttgacatgttaaataggctgtattgtaatgggatgtaaacaagagattgtgaatcgccacgggggtgatagattgaaaaatatattgagagcaatggttatccttttgattatctgcggaacttatgttctgtttattcaatatggatctgttcctgaaaagaaatcaaatgacagcgagcctcaggtgtcgaatgaggaagcgcaaagcggcaaacgaatacatatgccgacttcagggttattgtccttcatgggcaagcccgccgatgaagtaacgaaaaagcttggggaacctgaacgtattgacccttcggcttatgattacgattggtgggtatacaatcaaggtaaggatcaatatatccaaatcggggtattaaacaataaagtggtcacattattcgcgtcgggtaatgatattaacgccaagcctttcaaaattggagaatcaactggcgatgtattcaagaccacccaggtggcaccatttgtgaatgtagagtataaaggaaattcctatcggtttgaattttctgaagaagatatcaatacaagaccgactgtaaaggtaggaaagatgtatgtccagctgtatatggacaaatttgaggggaagctatccagcattagggcgtttgatgcgcagacctttgtaaagcaaagaccttatgaggtagtgtaccgcggggaattaattaaaccgaaagccgtttcagatgagaaatggaaaaagatccaaacaacgagcgaaaagcaaatccttgatttgacgaatgtcatacgcgttaaacatggacttgcgaagcttgaatgggatcagccaacggcggaggtggcgtttggacatagtgaggatatgaaggaaaataattatttctcccatgtctctaaaaaatacggctcgctgaaagaccgcttagaagaagggcatgttgactttcagcaagcgggtgaaaatatcgcatacaattatgtggacggaccggccgctgtagaaggctggctgaatagcgaaggccatcgaaaagcgcttctgaattcagattatacgcatcttggagtaggagtagaccgaaaatattacacccaaaattttattaaacgatggtaatgaaagccgcggacgaatggtcccggctttttctatttccatacaagctggtctgaatgaatgtgctgatagcttacagataaggccgtttcccatcccttcagtcaggctttttcaccagtgtatagggatatcggtaaaaattcatttgggaatgaatataggcgaacacaatgcccgacaaaacgatacattgtagtaggtaacgattttcggagggggtgaggattgtggcgaatcaacatgccaatcattcaatcaatgactttaaacaattcgtcaaaaagcatcccaagctgataaaagaagtgcgcaaagaacaaagtagctggcaggacgtatatgaaaattgggtcctcttcggggagagcgatccgatttgggatccgtatcgggaaccggaagaagcttctgaagctgtgcctgaaacaccgcaaaaaaatgattttgtctcgaaaatggtgacagcggtgaaaaagatggatgtcaatcaaatgaacgaacaaatcaataaaatgagccagtcgatctcatcgttgcaaagccttcttaatacattttccggaagcggacagaagcattctcagccaggttctggacagcatcctttttcttttcgaaaggattaaaaaaggggagctcatatgcgcaaagaggttcaggaatatattttagcaaacgaagaacggaaacgattcatcagagaacagccgatatggtaccgcagactttcaagaaaaccggatgatctgtcctcctttcagcttgaaatgatgaatttttatgaaaaaaccattccgcatcgggtgaaccagtttacgaacgggattcaaatggcgcaaatgatgatgcaaatgtttcaagcgatgcggacaaaagattaaaagaccctgaaaaagggtcttttttcatgcggtcataaggttttgttggcggctgcggttaagcattttccaattggctggtttcatggtaaactaacaactggaggtgcatgttatgtatgcgacgatggaatccgtgcggcttcaaagtgaagctcagcagcttgccgagatgattctgcagtcggagacggctgagaactaccgcaattgttacaagcgtctccaggaagatgaagaggcaggtcggattattcgttcttttatcaaaataaaagagcagtatgaggatgtacagcgttttggcaaatatcatcctgactatagagaaatatcccggaaaatgagggagatcaaacgtgagctggacctgaacgacaaggtggctgacttcaagagagctgaaaatgagctccagtccattcttgatgaggtcagcgttgagattgggacagctgtttcggagcatgtgaaagttccgactgggaacccttattttgacggtttgtcttcatgcggaggcggctgcggttcaggcggaagctgcggatgtaaagtgtcctgacgagactggccgtctcgtcttttacatataagagaaaacaggcaggtgattgtattggagaataggcgccagggcatggttgtgtatctgcactccctaaagcaaagcaaaatgctgaggaagttcgggaatgtgcactatgtatcaaaacgattaaaatatgtcgtactgtactgtgatatggaccaaattcaaaaaacaatggacaagattgcgtcttactcatttgtgaaaaaagtggagccttcttataaaccgtttttaaaattggaattcgagtcaaagcttgataaggcaaaagaatacgattataaaatcggcatatagctataaaaaaatccccgcaggcatctgcggggtccttctattccttaatatgttaaggagaaggcaaagggagaggagaaaccggaggaagaacttatggggaaacgtaagtcttctccgcggttggcaacaacatcctctagatgctgttgcttatagtatggacaaggatcatgctgcctatacacctgtttaccaagattagcgttcattgtttggaagaatgctttatgttaagataggattgatttttttctatgtacatagcggcgtccggccgaataaagaaacaaaatagcttttagaaaaagtggtgtggaacatgagagtaatttctggatcaaaaaaaggccgttcactaaaggctgtacccggaacatcaacaagaccgacaaccgacaaagtgaaggaatccattttcaatatgatcggcccttattttgacgggggcaggggacttgacttattcgcagggagcggaggtcttggaatcgaagcgctttcacgcgggtttgagcattgtatattcgttgaccgtgattttaaagcgattcaaacggtaaaatctaatttgaaaacgctggagcttacaaaacatgcacaggtataccgcaatgatgcggaacgtgctttgcacgctgctgctaaaagagaaaccggctttcgcggcatttttctcgatccgccgtataaggaacaaaagctgaaagcacttttaacgctgattgacgaatatcaaatgctggaagaaaacggctttatcgtcgctgagcatgacagagaggtcgagcttcccgaaaccgtaggagatcttgtgatgacaagaaaagaaacctatgggcttacaggtgtggcgatttataaaaagagggggtagtgaggtggcgagtatagctgtctgtcccggcagttttgatccggtgacctacgggcatctggacatcatcaaacgcggggcgcatatttttgaacaagtgtatgtatgtgtgctgaataattcttcaaaaaagcctttgttcagtgtggaagaacggtgtgagcttctgagagaagtgacaaaagacattccgaacataacagttgaaacatcgcaaggcctgttaattgattatgcaaaaagaaaaaatgcgaaagcgattttaagaggcttgagagctgtatctgattttgaatacgagatgcaggggacgtcagtaaaccgtgtgcttgatgaatccatcgagacattttttatgatgacaaacaatcaatattcgtttctaagttcaagcatcgtaaaagaagtggcgagatacaacggctcggtatcagagtttgtaccgccggaagtagagctggcgcttcagcaaaaattcagacaaggatgagggttttgactcatcctttttttgttccgtttgtcagtctgtaagaaaaaatgataatgtacgtaaacagcgcgcatagtgtgacagcaggtccgatctgcacaagcagattccagccgtttataaaggcagttggcatgtcactgctgttaagagatttaaatacatactgatatggatcatgccatgccgtgtaaagaggtttccataaaagcatgacgaagacagcggcataaacgccctgcagcaaacgtgcgataaagaatggtttaaatcgaatgtcggtttccgataaaatacctgccacctgagcttgtacggaaaagccgctaaacccgagaataaagctgacgataatggctttttgcagaagagaaacatctgtctcgctgacaagcttgctgcctaatgtaatttcaaacatccctgataaaagcggaatgtccaattgagtcggaagctgaaacaaagtcagtgctccttttgtgaaaacagacaaaacatcagtcagctggaccactgacaacagtcgattgaagacagaaaataaaataataaagccgcctaccataagaagcgtttgaacagaagacgtcacggcgtcgcctaaaattttacccaagggccgtttttctgcaagtctggcggtatgaagagcgtgtaaagcatctttgactgaagggaaaggtatcgttttctttcttctgagttgctgctcttccttgcggccataggaacgcattgttaaaccgacggcaagattccccaaatagtgtgcagaagctaataaaatgcctagtgacgcgttttgaaagaaaccgacggcaacagcgccgaaaataaagagcgggtttgaagaattggtaaacgacgcgagccgttctgcctctactcttgaaatctgattttcctgccgcagacgggcagtgagttttgcgcccgctgggtttcctgatgccattcccatagcaagaacgaagccgccgacacccggcacgcgaaagatcggccgcataaaaggctcaagcaaaacaccgacaaaccgcacaatgccaaagccgattaagagttcggacagaataaaaaatggcagcaatgacggaaacacaacctcccaccacatagacagcccggttttagaggcttcgaatgaagcctgtggatgtgagatgacagtcgctgttaaaaaaagaaaaaacgaggcaatcaaaagtgtattaatcttcgacaagttcattcttacctccccgatgctaaaaatgcccaatgacatgtatatcatgataaaataatgtatgatgtaaaacggccaagcagtacctgtcctcttgattctttgtactaatatacgagcataggggttcagtttagaccatagaattcgatatacagggaattcaggcaggaggttaacgctttggccaaacctaaaatcgggttagcgttaggatcgggaggggccagagggctcgctcatctcggtgtgctttccagtttacataagcaccaaattgaagtggatatgattgcaggaagcagcatgggcgctttggtgggcagtttttacgccgccggacatgacgtggcaacgatgaaaaaagtagccaaagcctttaaacgaaggctttatgctgattatacggttccgaaactcggttttttaaaaggtgaccgcgtcagacagcttgtgcatgcttatacattcggaaaaccgattgaagagctccaaatcccgctgggcattgttgcgtgtgatctacagacgggagaaaagattgtgttccgaaaaggatcagtgtcagatgcagtgagggccagcatcagcatcccgggtatctttattccgcagcggctggacggacgccttcttgtagacggcgcggtcgtcgatcgaattccggtttctgttgtgaaagacatgggagctgaaattattatcgcttcggatgtttccagggttcgaaaaactgaaacagcagtgcatatttttgatgtgattatgcaaagtatggatatactgcaaaatgaattagtgcggcatcaaacaattgccgcagatatcatgattcgcccttcccttgaaacatacagctcaagctcgtttgccaatattgaagaaatgatatcggcaggcgaagaggcgacaaatcgaatgatcagcaagataagaaaagaaatagagaattgggagggctcataatttgctacgtaaaaaacattttagctggatgctcgtcatcctcatactgatcgccgttttatcatttataaaacttccatactatattacaaaaccgggagaagcgacagagcttgcttcattgataaaagtggagggaggctacccggaaaaaggaagcctgtccttaatgactgttaaagtgggaccggctaatccgtttacatatgtgtgggcaaagatgcacccttattatgaaattgttcctgatgagagcattaaggaggaaggcgagtcagataaggagtatatgaaaagacagctccaaatgatgaaaagctcgcaagaaaatgcggttatagccgcctatcaaaaggcaggaaaaaaagtcacctattcctttaacggcatatacgcaagctctgttgtagaaaacatgccggcaaaagggaaaatagaagtcggtgataaaatcatcagcgcagacggcaaaaactatcagtctgctgaaaagctaattgattatatcagcagcaaaaaagcgggagataaagtcacgttaaagatcgaaagagaagaaaaagaaaagcgtgtcacccttacgttaaaacaatttcctgatgagccggatcgggcaggaatcggagtttcgctttatacagacagaaacgtgaaggtagagcctgatattgattttgaaattgaaaatattggcggtccgtcagcagggttaatgatgtcccttgaaatctataatcagctgacaaaaccagacgaaacaaaaggctacgatattgcgggaacaggtaccattgatgttgatgggaaagtaggcccgatcggcggcattgatcaaaaagtcgtcgccgcagacaaagccggaaaagacattttcttcgcgccaaatcaaaacggcgccagcaattccgattataagaacgcagtaaaaacagcaaaagatattgattcaaatatgaagattgtgcctgttgataccatgcaggatgcgattgattatttgaataagctgaaagcgaaaagcacctgattctcaggtgctttttctatacatttaaaaagtgttgttcatcttcatcatatcgaatcggtgcatgtccgtattcctgcaggtcaaactcagttctcagcggctcttctatcggcaggctgtaaatcctgcttgcttttacgtccagatcgagagctggatgggagaaagaggacagtttgctgacaagcggaacagacagtgcttttttcttttcggataaataagcctgtcctttttttgtcatgccgagaagcctgatatacggcgccttatcgttgtcaagcagcttttgcatatcctgtttttttgttctggttaaaatgtgtgtattcatccgctggagccttgtccacgtatagcgttttgttttcagcagttccataaattcctgataggagctggattttctgatcgaacgaagaattctgtgctctaaaccttcctccacctcgtatacttgctgtaattcctgtgccgttacagttgaaaggctgtattttaagtaagaaaagtagctctcaggtgtatgccacaatccgaaagatttgcggtaagctgctaattcacgtgcagatgcagcagggagaaaacgaaggcaggcttcgagattctggccagtcatcgcttttctgatgcttgtggcgcttgcaatgtggttttcgccttcagggagatcggcatcatgatagtccgaagagatgcgtgccgtggtataaggtttcatagggtatcccccggttagaatcgaagtcacatactggtaccccaaaatgttatttggttttgacaagtcaagtgcactttcggtatgcaaaatggagctgaaggcgctagccgccgctgctgggtaactcgtccccgttttaagttcttctttaattcggtcatcaaatgtatgtttatgctcaccaataagctgtgctgtttctaaaaacggcttgatatccccattttcactcccgaaaaacagcgccttacattcaagttcgttcaggatggaaacactgccgcgtgcaaaaatgtctgctttttgcacggcataaagataaggcagctcaataacaagatcaactccgctttgcagcgccatttttgttcgggcccattttgacacaacagccggttccccacgctgtaaaaaatgcccgctcatgaccgcgacagccgtgtcacatccggtttgccgctttgctgtttgggcatgataaaggtgaccgttatgaaagggattatattcaaccaccaatccgacagctttcatattttttccgcctttcttgctatgtttaaaaacgtatggtacatttgcaaatgaaaactcttacgccttatttttgttttaagtgtatgcatagcatattccgctgtcaacgatacttcaatggcagcattatgctgtaaagaaaaaatattgacaaaaacaatcttaaaagctataatcatgtttgttgctttcctgaggtgatacaaatgaaatggacgatttatcagctgcatcaaatgccaaaacaaagttttgagtttgatgaaacagttgagttaaatgagctgacaaagctgaattctgacattcgccgcatttctcccgtccgggtgaagggcagagcggatatcaaatccaaacaggtttcgtttgattttacaatttcaggcgaaatgattttgccatgctcaagaacactcgttgatgtcccgtatccatttgaaatttcaacaaaagaactgtttatatttcatcacacggatgatatagaagatgatgacgttcatattgttgaggacgatactatcgacttaactccgatcgtgaaagaagaaattcttttagaaatccctatgcaaatcttttgtgaatctgaacaagaaaaaggagctgctcctcaagaaggaaaggattggcaagtcatttcggaagaagacaagaagaatcaagttgatccgagacttgcagcccttgaaaagctcttaaaacaagatgatgaatcttaactctttaaggaggtgggaataatggctgtaccttttagaagaacttctaaaatgaagaaaagattgcgccgtacacatttcaaacttaatgtacctggtatgacagaatgtccgtcatgcggagagatgaagttgtctcaccgtgtatgcaaagcatgcggatcatacaacggcaaagacataaatgtaaaaagtaactaataagaaaagcgcggggtgaaagccctgcgctttttctttttctcttcctgtcagcttgcggaaaatttgtgagtgcaaatagtctatctaatctattaccggcatatgtatgagataaataagctgacatggagggagattgaatttgaccattacaagacaagatgcttggactcaggatgaggatttgctgctggcagaagtggtgcttcgtcatattcgagagggaggaacacagctttcagcctttgaggaggttgggagggcgctgaccagaaccgcggcagcctgtggtttcaggtggaactcgtatgtgagaaaacaataccagtcaggtatagagcttgcaaaaaagcaaaggaaagaactgagaaagcaaatcggcgttcattcggtcaatatgccgaattccatgaagcagactgcctcggcatcgtcagaaggaaaacgagatttgtccattcaggatgtcattcaatttctcgaacaattcaaagaagcgccgtctgcacaagaatttcagcttgaaagggaaaaattgaaggagcaaatccaatcgttgcaaaaagagcttgaggatttgcggagtgaaaatcagacattgcggaatcagctagagatgacagaagaggattacaaggcactgatcgatatcatggatcgggccagaaaaatggttgtttcgaaggaagacggaagaatgaaaaaagcggctcaagaaacgtaaagaaacgcctaaaatgaaccggccctatagtaagaataggccggttgttttgatttctatgcagactctcccggtgtcatttcgtgatccatatcaggatgccagatgagcgggttttcccctttgtcccgcgccatatcatacttaacagttttaaagttcattttgttccaaaattccgctgatttcattcgcggatttgtccggatcggcattttgaatgattttgcaaattcaaccaaggctctcccgtatcccctgttctggtagcccggtagaacctcaagcttccacagctccaaataatcctggcggttgtcaaaatagggattcgatttgccgttaacttgatacagactcattcgtgctacaagtttatcgccaaaataaatcccgtaaaaaggcgaggtgctgtcattttcaataatattatcctgaagttcttcaagcatagaaagctcctgaatgccgtattctttgaatttcttgaattcttccagcgttttatagttgataagcagacgttctacctttgtcaaacaaatctccccctttgtgtttctacatatattgtaaacgctttatttaaaaaatccaaatatttaaactttaattttaagcacatgggatctttgagaagtaatttcttcttacttctgctatgataatacgtaaatgctaaattgggtgtgacatcatgaaaattggaattatcggcggaggctccgtcggtcttttatgcgcctattatttgtcacttgatcacaacgtgactgttgtgacgaggcggcaagaacaggctgcggccattcagtctgaaggaatccggctttataaaggcggggaggaattcagggctgattgcagtgcggacacgagtatcaattcggactttgacctgcttgtcgtgacagtgaagcagcatcagcttcaatctgttttttcgtcgcttgaacgaatcgggaagacgaatatattatttttgcaaaacggcatggggcatatccacgacctaaaagactggcacgttggccattccatttatgttggaatcgttgagcacggagctgtaagaaaatcggatacagctgttgatcatacaggcctaggtgcgataaaatggagcgcgttcgacgatgctgaaccagaccggctgaacatcatgtttcagcataaccattcggattttccgatttattatgagacggattggtaccgtctgctgacgggcaagctgattgtaaatgcgtgtattaatcctttaactgcgttattgcaggtgaaaaatggagaactgctgacaacgccagcttatctggcttttatgaagctggtatttcaggaggcatgccgcattttaaaacttgaaaatgaagaaaaggcttgggagcgggttcaggctgtttgtggacaaacgaaagagaatcgttcatcaatgctggttgacgtcattggaggccggcagacggaagctgacgccattatcggatacttattgaaggaagcaagtcttcaaggtcttgatgccgtccacctagagtttttatatggcagcatcaaagcattggagcgaaatacaaacaaagtcttttgagctttttcggtaacatgctatactcatttcggatcactaactatttattggagaaaggaagttctagaagatgcagctaactgaactttccatcaaaaatcagaatgtgtttgtacagcactatatagatggcaaagaagaaatgtcttctttttttgattacagtattcatcataaggacatgtggcgcgaaagactggaagacttatcttcccggtttttcgcaagagaggaattggcggcgtacttaacctcttaccataataaattcggttcaagtgcgatgcagtctgctattgagaagctgaaggacccgtcaagtgccgctgtagtcggcggacagcaggcaggacttttaacaggaccgctttacaccatacataaaatcatttcaatcattgttttagcaaagcaacaagaaaaggaactgcaagtgcctgtcataccaatcttctgggtggctggagaagaccacgatttggatgagattaattttgttcacacatctgaagagaatgggcctgtgaaaaaaaagctgcctcagtcttattggaagaaatcatcagcagcgagtacatcgcttgatcaggaaaagtgtgccgcgtggatagatgatgtttttgccgcttttgaagaaacagaccatacgaatacacttctcgacaatgtgaaacgatgtttaagggaatctgttacgtttactgacttctttgaactgctgatcgcggatttgttccaagaagagggcttagttttattaaattctggagatccggggattaaaaagctggaaacggccatgttccaaaagattcttcgagaaaatgatgaactcgcccgggctgtatcagatcagcaggccttcatgcgtcaagcaggctacaaaccgattatcgagtccggaaaagagcaggcgaatctgttttatgaatacgaagaagagcgttttttaattgaaaaagataacggccgatttgtcatcaaagagcttgatctaggatggacgatggatgaacttcatacacatatggaagaacatccagagcgtttcagcaacaatgttgtaacgagaccgttaatgcaggaatttctcattccgactttagcatttattgcagggcctggagaaatcaactattggggcgagctcaaacaggcttttgcggtgatgggtttcaaaatgcctcctgtcatgccaaggctgaacattacgatacttgagcggcatattgagaaaaaactggctgaacggaatatctcgttacaagacgcgattgagagcggaacggagaatcaaagagagacatacttcgagcgccagattccggaagagtttacggcggtgatggatcaggcgaaaagccaaattgaagcgattcacaaaacggtccggcaggaggcgttaaaggttgatcaaagcatggaacctttactcctgaaaaatgccgcttttattcaggatcagcttcaattcttagagcacacggtgacgaagcgaattgaagaaaaagaaggctacgtcttgaaggattatgaaagaattcaaaatagcattaagccgcttcttgcgccgcaagaacggatttggaatatcatgtattatttgaacaggtacggtccaaaattcttcacgacattcaagaatctgccattttcttttcaaaatcaacatcaagttgtcaaactttgaaataaagttttaaagaaccctgaatagttcagggtttttttttatgggtaaacagtgtaaaatgaagttgtggagcgaagtggtgaatagtggtgagttaaggagagaaagtggggcaagagatcatgtttatgggtgaatatcagcataccatcgatgcgaaaggccgcatgatcgtacccgctaaatttagagaaggcctaggtgagcaatttgtgctgactagaggacttgaccaatgtctcttcggctaccctatgcacgaatggaaacaaattgaagaaaaactaaaagctctgcctctcacaaagaaagatgcccgcgcgtttacccgtttcttcttttcaggggcgactgaatgcgaactggacaagcaaggcagggtaaatatcgcatcatctctattgaattacgccaaactggaaaaagaatgtgttgttatcggggtttctaatcgaattgaattgtggagtaaagtaatttgggaacaatacacagaagagcaagaagattcatttgctgaaattgctgaaaacatgattgggtttgatatataatgattcttcgtgtataacactctaaaaacaatttcaattcatccttataaaaggtgggaccaacacaatatgtttcaacacaagacagtacttcttcgtgaaaccgtagacggacttaatattaaaccagacggtacatatgtagactgcacactcggcggagctgggcatagtacatacttattgcagcagttatccgagaaggggcgtttaatcgcttttgaccaagatgatacggcattacagcatgctaaagaagtgttgtccgattataaaggacagctcattctgattaaaagcaatttcaggtatttaaaagaatgtttgaatgaacaaggcattacagaagtagacggtattttatttgatttaggggtgtcctctccgcagctggatacacctgagcgcggattcagttaccatcatgacgcaccgttggacatgaggatggaccagtcggctacgctttcggcgaaagaagtcgttaatgagtggcgctatgaggatctcgtccgtattttctttaaatacggagaagagaagttcagtaaacagatcgccagaaaaattgaggaggcaagaatgaagtctcctattcaaactacgggccaactggtcgatctaataaaagacgcgattcccgctccagcgagaaggagcggcggacatcccgctaaacgcgtgtttcaggcaatcagaattgccgtaaacgatgaacttagggtgtttgaagaagctttggagcaggcaattgaggttctgaagccagggggcagggtatcggtcattaccttccactcgctagaagacagaatttgcaaaaccacttttaaagaaaagtcgtcgcttccggaacttcctccggggcttcctgttataccggaagagtttgaaccggagctgaagctcatcacacgaaaaccgattacggcatctcaagaagagcttgaagagaacaaccgggctcgttctgccaagcttcggattgctgaaaaaagaaaataacgaaacgcgaacgcaaaattaaaaggaggtcatcagcctatgagcaatttagcttaccaaccagagaaacagcagcggcatgcgatcagtcctgagaaaaaagtgattgtcaagaaaagggcttccattactctcggagaaaaagtgcttcttgtcctctttgctgcggcggtgctcagcgtatcgcttttgatcgtatcgaaggcgtatgcggcatatcaaaccaatattgaggtgcaaaagcttgaggagcaaatttcatccgaaaataagcaaattggtgacctcgaaaaaagcgttgctgatttaagcaaaccgcagcgcattatggacattgcgaaaaagaacggcttgaatttaaaagataaaaaagtgaaaaacatacaggaatgattcaaatgccaaaaaagaataaatttatgaatagaggagcagcgattctaagtatttgtttcgctctctttttctttgtcatcctggggagaatggcatatattcaaataaccggaaaagcgaacggcgaagtgcttgcgacaaaagcgacagagcagcatgaaaagaaacggaccatcgaagcgagccgcggctcgattttagaccgaaaaggaaaagtcattgcagaggacacagcgacgtataaactgattgcgattctcgataaaaaaatgaccactgatgtcaagcatcctcagcatgttgtaaacaaagaaaaaacggcggaagcattgtctaaagtgataaacttggacaaggccgacatccttgatatcttaaataaagatgcaaaacaagtcgagtttggctcagctggccgggatattacgtattcacaaaagcaaaaaattgaaaaaatgaaactcccgggcatttcatttttgcgggatacaaaacgctactatccaaatggtattttcgcatccaatttaatcggctatgccgaggttgatcaagacacaaatgaaatttccggcgcgatggggttagaaaaagtgctggataagtatttgaaggagcgcgacggatatgtgacatatgaaagcgacaaatccggctgggagctcccgaacagcaaaaataaaattacagcgccaaaaaatggtgacaatgtatatttaaccattgaccagaaaattcaaacctttttggaagacagcatgacaaaagtggcgcaaaagtataatccgaaaaaaatcatggccgcagtcgtcgatccgaaaacgggcaaagtgcttgccatgggacagcgcccaagctttgatccgaacaagcgcgatgtgacaaactactataatgatttgatttcatatgcgtatgagcccggatccacgatgaagatctttacactcgctgctgcgatgcaggaaaacgtgtttaatgcgaacgaaaaatataaatcagggacatttgaagttggcggagcacctgttaaggatcacaataacggtgtaggctggggtccgacaacatatcatgacggcgtcctaaggtcgtcgaatgtcgcttttgcgaaactggcgaaagaaaagctgggatatgaccgcctcaatcaatatttgcacaaattcaatttttaccagaaaacaggtattgatttgccaggagaagtctccagcaaaatcaactttaaatatgaatttgataaggcgtcaactgcatatggccaagcgtctgcggtcacaccaattcagcagattcaggccgcaacggcaattgcaaatgacggcaaaatgatgaaaccttatgtcattgaccatatcgttgatcccgataaagataaaactatttatcaaaataagccggaatcagccggaaccccaatttctgcaagcacagcgaaaaaggtgcgggatatattgggagaagttgttacgtcgaaaatcggaacagggcaagcatataaaatcgaaggttttgatgttgccgggaaaacaggtactgcgcaaatagccggtaaaggcggatatttagacggcacagataactatatcttttcgtttatgggtatggcgccaaaagatgatcctgagcttttaatttatgtggctgtacagcagccgcaactaaaagcaggacaaagcagttcagatccagtatcagaaatcttcaatccaacaatgaaaaacagcctgcactacctaaacatcgaaccaactgaaaaatctgactcagataaggaagaaacaaaagcgcagacaatgcctgatttaacagatcaaacggtagctgctgctcaaaagaaagcaaaagaggagaatctcacaccaattgtcatcggcagtgatgtcgctgtaaaagaacagtatccgaaagcggatgaggaagttctcaccaatcaaaaggtcttcctgaaaacgggcggcaaaatcaaaatgcctgatatgacaggctggtcgagaagagaggttctgcagtacggcgagctcgcgggaattcatattgaagtaagcggacaaggctacgctgtcagccaaagtgttaagaaagacaaagaaatcaaagacaaaaccgtaatcaaggttaagtttaaaaatcctgattaaaaagaaagccgtcgttatgcaggctttctttttttatgccttcagaggagcatcgttctacctgtccaaattcaggcataaaatgaaacaagcctaaataaggagtgaacggtctcttgcgcgtctcgaatgtaacggttagaaaacgtttattatttgttttgctttttggcgtgatcgtgtttctgatcattgatacaaggctggggtatgttcagtttgtgatgggcgaaaaactgacttcgctagcgaaagattcctggagccggaacttgccgtttgagccggagagaggcgagattctggatcggaatggtgtgaagctcgcaacaaataaaagtgcgccgaccgtattcgtcgtgccgcgccaagttcagaatccgatgaaaacgagcaagcagcttgcggcggtgctcaatatgtcagaagaaaaagtatataaacatgtgactaaaaaagcgtcaatcgaaaagatcactcctgaagggagaaaaatttcaaatgagaaggcgaaagaagtcaaagcgcttgatttaaaaggtgtgtatgttgcggaggacagtattcgtcattacccgttcggcagctttttatctcatgtgcttggatttgcaggaattgacaaccaagggctccttggacttgaagcctattacgacgatgatttaaaaggggaaaaaggttctgttaagttttatacagatgccaaggggaagaagatgcctgatgaagcggatgactatacgccgcctaaggatgggcttgatatgaagctgacggttgattcaaaggtccagacgataatggaaagagagcttgataacgctgaggccaaatatcatccggacggcatgattgccgtagccatgaatccgaaaaacggagaaattttggggatgtctagcaggcctgacttcgaccctgctgattaccaatctgttgatccgtccgtctacaatcgaaatctgccagtatggagcacgtatgaaccgggatctacctttaaaattattacacttgcagcagcccttgaagagcaaaaagtaaatttgaaacgggatcaattttatgataaagggcatgcggaagtggacggagcgagactgcggtgctggaaaagaggcgggcacgggctgcagacgtatctggaagttgtgcagaactcctgcaacccggggtttgttgaattaggcgagcgcttaggaaaggaaaagcttttcaaatatatcaaagactttggttttggacaaaaaacggggattgatctccaaggcgagggaacaggcatcttattcccgcttgagagagtgggcccggtggagcaagcaactacggctttcggacagggagtatccgtcacgccgattcagcaggttgcagcagtatccgccgctgtaaacggaggaacgctctatacaccttatattgcaaaggaatggatcgatcctgttacgaagaaaacggtcaaaaaacaatcaccaatcgcaaagaaacaagtcatttctgaggaaacatccaaacaaatccgctatgctctagaaagcgtcgtcgcagaaggaaccggccgcaatgcatttgtagaaggatatcgtgtcggaggaaaaacgggaactgcacaaaaggttaaagatggaaaatatcttgaaaacaaccatattgtatcatttatcggtttcgcgccagctgatgatccgagtctagtcgtctacgttgcggtggataacccgaaaggcacgattcagtttggcggaacggtggcagcgcctattgtcggaaatattatgagagacagtctgccggaacttggtgtgaagccccggaaaaatcaaatcgagaaaaaataccaatggaacgacacaaaaacaatagaagttccgaatgttgtagggatgtctgtctcagatcttgagtcactattggtgaatctcaatgtggatgcttccgggaaagggagcaaaatcgttaaacaatcgccagctgccggaacgaaagtaaaagaaggctcaaagatacgcgtgtatttgactgaagaagatgaaaaggaggcagccgattgattcgggctgcctattcttttattgcagaaaaaatgctgatatctttcaagattagctggatgtatccttttatttacgctaaaatatgaactgtatgcttaaaatcattaccacatcatttgatgtgacttcaatgataaaaagaacgaattagaatgttgagaggtttgatacgatgaaacttacaaagctgcttacatacttaacaaccgaaccttctgtaaacgactcacaagaccctgaaataacttcaattgagatggactccagggaagtaaagaaagggagtctttttgtatgtgtaaaagggtatacggtggatggccacgattttgcgcaaaaagcagtagaaaacggtgcagcggctattgtggcagaaagagaggtcgatgtgaatgttcctgttattattgtccggcagtcacttcgcgcgctcagcgttttgtctgatgcgttttacggacagccgacgaagaagcttcagctgattgggataacagggacaaacggcaaaacatcaacgacccacatggtcgatgagattctgaaaaaagcgggaaaacgcacaggcttgatcggtacaatgtacatgaaaatcggagacgaaacacttcctgttaaaaacacgactccggaaagcgtcacgctgcagaaaacgtttaagaaaatgaatgacaagcacgttgacactgcaatcatggaggtttcttcccacgctttgtctttaggacgcgtccatggctgtgattatgatattgccgtgtttacgaatttaacacaggaccatctggactatcataaaacgatggatgagtaccggcatgcaaaaagcttgctcttttcccaacttggcggggctttcaaccatgaacatccaaagcgtgccgtcctgaatgctgacgatgaggcgagcgcttattttgaaaaggtaacagctgcgcatatctctacatacggaattaaaaacgatgctgatgtgatggcgaagaacatcagtatcactgcacagggcacaagctttgatctcgtgacaaacaaaggcacgaagcacatcacgatgtctctcgtcggacaatttaatgtgtataacgtgctggccgctgttgcgacatgtattgcagcaggcataccgtttgaaatcatcactgaggctgttgaagaattgcatggtgtaagaggccgttttgaattggtcaatcagcagcaggagtttcctgtcattgtagactacgcgcacacaccggacagccttgaaaatgtgctggagacatgcagagacatgacggaaggaaagctatttgtcgttgtcggctgcggaggagacagagataagacgaagcgcccgaaaatggctaaaattgctgtggagctggctgacgagccgattttcacgtcagataacccgagaagcgaagatcctcgcgcgattttaagagatatggaagccggagtagagaacgcatactatcacagtattgcaaaccgcgagcaggcgatctttttcgcaattgccaatgccaaaaaaggcgacgttgtcctcattgccggaaaaggacatgaaacctatcagcagatcggaaatgaaactttcgattttgatgatgctgaagtagcggcgagagccattgttgaactcaataagaataagacgaattcataggaaagagatgttactgaataatggagcttgaaaagatttttcatatggaaaaaaatcatgaatatgataactacgtatgtcgtttgaaagaaacaggaggagaaaaggacaatgcttgagcaagtcattctgtttacaattttaatggggtttttaattagtgttctgctctctccgattcttattccgtttttaagaagattaaaattcggccagagtattagagaagaaggaccgaaatcacatcagaaaaaatcagggacaccgacaatgggcggggtcatgatcatactttctatcatagtgacaacaattgttatgacacagaagttttcagaaataagccccgaaatggtgctgcttctgtttgttacgctaggctacggtttgcttggctttttagatgattacatcaaggttgtcatgaagcgcaatcttggattgacatcaaagcaaaagctgatcggacaaattattattgcagttgtattttacgccgtgtatcattactacaattttgcgacggatattcgcattcctggaactgacttatcatttgatcttggctgggcttactttatccttgtgctctttatgcttgtcggcggatcaaacgcagttaacctgactgacggccttgacgggttattatccggtactgcggcgattgcctttggcgcctttgccattctggcatggaatcagtctcaatatgacgtagcgattttctcagttgccgttgtcggtgcagttctgggcttccttgtatttaatgctcatccggccaaagtttttatgggagatacgggatcgcttgcattgggaggagccatcgttaccattgccattttaacgaaattagagatcctgctggttatcatcggcggtgtattcgttatcgagacattatctgttattttgcaggtcatcagctttaaaacgacaggtaaacgaatctttaaaatgagtccgcttcatcaccattatgagcttgtcggctggtctgaatggagagtagtcgtgacgttttgggctgcgggacttttgcttgccgttttaggaatttacatcgaggtgtggttataagtggaaaatgatcaatttttacagaaacagcattttttaatccttgggcttgcgaaaagcggatatgcggcggcctccattcttcatgaaaaaggcatttatgttgcagtcaatgaccaaaagccttttgaagaaaatgaaccggcacaaaagctttctgaaaaaggaatcgaagttgtttgcggagagcatccagtttctctgttcgatcagcatcaaatcacgattctgatcaaaaacccgggaattccttatgaaaatattatggttcaggaagcggagaaaagaggtattccggtttggacggaaattgagctcgcttactacctgaccagcgccaagtttatcgggattaccggatcgaacggtaaaacgaccacgacaacgctaatttacgaaatgctcaaagctgactcgcaaaaagcactgattgccggaaacatcggcacagtcgcaagtgaggttgcctatcatgctgatggagatgaatggatcgttaccgaactgtcttcgtttcagctgatgggaacacacgctttcagaccggaaatcagcctgattttaaatgtatttgacgcccatctggattatcaccatacgcgcgaaaactatgaaaaagcgaaacagaaagtgtaccttcatcagactgcttcagataaagccattgtcaaccaggatgatgaaaccgtcgtgcgtcttgctgaagccggaaaagccgaaatcgtcccattttcagtcagcaaaacgcttgaacagggcgcatatgtaaaagacagtatgattatgtttaacggcgaagccattcttcctctggaagaggttgtgctgcccggtgctcataacctggagaacattttagcagctattgcagttgtgaaaacggcaggagcatccaatgaggcggttaaaaaggtgctgacaagctttactggtgtgaagcaccgcctccaatatgtcacaactgtgaatggccgcaaattttataacgacagtaaagcaacaaacattctggcgacaagcaaggcgctttcagcttttgataagccggtcattctgcttgcgggcggactggatcgcggaaatggttttgatgacttgaaaccttatatgaagcatgtcaaagcagtgcttacatttggccagacggcgccaaaactcgagaaactcggcaatgaactgggaatacaacatgtcaaacgtgtcgataatgttgaacaagcagtatctgcggcgtttgcgctctcaaatgaaggagatgtcatcctgctgtcacccgcgtgtgcgagctgggatcaattcaaaacatttgaagaacgcggtgacatgtttatagatgccgtgcatatgcttaagtaagggcttgtcttgaagtaaatcggcagccctaatgactttaagcttggggtgtcgattgctttgactactaaaaaaacatcgcctgatttgttattggtcatcattacgttattattattaacaatcggattaattatggtgtacagtgcgagtgcggtatgggcggattataaatttgacgactcattctttttcgcgaaacggcagcttttgtttgcgggaatcggcgtcattgctatgttttttatcatgaatgtcgattattggacttggaggacatggtccaaattgctgatggttatctgctttttccttctggtgcttgttttgataccgggcgtcggaatggtgcggaacggttcaagaagctggatcggagtcggagcattcagcatacagccttcagagtttatgaagcttgcgatgattgcattccttgctaaatttctctctgaaaaacaaaaaaacatcacatcgttcagacgggggttcgtccctgcacttggcatcgtgttttcagcatttttgattatcatgtgccagcctgacctcggaacggggacagtaatggtcggaacttgtattgtcatgatttttgtagccggcgcgcggatcgcccatttcgtctttctcggactgatcggcctcagcggatttgtcgggctcgtactatcagctccatatcggattaagcggattacctcatacttaaatccatgggaagacccgctcggaagcggatttcagatcattcaatcgctttatgcagtggggcccggcgggttgttcggaatggggctcggacaaagcagacagaaattcttttatctgcctgagccgcaaacagactttattttcgccatcttgtcagaggagctgggctttatcgggggaacacttattttgctcctcttcagcgtcctgctgtggagaggaatcagaattgcgcttggtgcccctgatctgtacggaagctttgtcgcagtcggtattatttcaatgattgccattcaagtcatgatcaatatcggcgtagtcacgggcctgattcctgtaacaggcatcacgctcccgtttctgagctacggaggctcttcattgactctaatgctgatggcagttggtgtgctgctgaatgtaagccgctactcgaggtattaacgaatgtatgtccatgcttcctgtctaacatgaagcttggaaacaattgatgcgataaccctgtccaacaaaacagggttatcgttatgttatagagaaacttagactgggggaaaagaaatgcgaattgcaataagcggaggcggtacagggggacatatttatcctgcgcttgcttttattaaagaagtgcaaagacgtcatcctaatgtggaatttttatatattggaacagaaaacgggctggagaaaaaaattgttgagcgggagaatataccgtttcgttcaattgaaattacaggatttaaaagaaaattgtcatttgaaaatgtcaagactgtgatgcgttttctgaagggcgtcaaaaagagtaaatcgtatttagcggaatttaagcccgatgccgtaattggaacgggcggttatgtatgcgggccggttgtctatgccgctgcgaaaatgggaattccgactattgtccatgaacaaaacagcctgccgggcatcacgaataagtttctttcaaaatatgttaataaagtagcgatttgttttgaagaagcgaaatcacattttcctagcgagaaagttgtatttacgggaaacccgcgagcctctgaagtcgtctcaataaagacgggacgatcaatggctgaatttgggctttctgaagagaaaaaaacggtcttaattttcggcggaagccgaggcgctgcaccgattaaccgcgctgtcattgacatgcaggatgcgctgaaaacaagagactatcaagtgctgtatatcaccggtgaagttcactatgaaaaagtaatgaatgagctgaaaagcaagggtgccgctgataatatggtcacaaagccgtttcttcatcaaatgcctgagtatttaaaggccattgatgtcattgtggccagagccggtgcgacaacgattgccgaaattactgctctcggaatcccaagtgttctgatcccgagtccatatgtgacagcgaatcaccaggaggtcaatgcgagatctctcggccagcatgatgcggcgattgtactgaaagaaacagagctcagcggggagaagctgattgaagcgctagaccgaattgtactgaatgagcaaacgttaaaggaaatgagcgaacgaacaaagtcactcggtgttcctgacgcggctgcccgtttatacagcgtactcgaggaattaaaaaaatagtagaaaagcaaatggaatgcggaggtttacgatggagaaagtgatacaggaattaaaagaacgcgaagtcggcaaggttcttgcaaatgaaccgctcgcgaatcatacaacgatgaaaatcggcggacctgcggatgtattggtcattccaagcagtgtagatgctgttaaagacatcatggacgtgattaaaaaatatgatgtgaagtggacagtcatcggccgcggatcaaatcttcttgttttagatgaaggaattagaggcgtagtgatcaagctgggtgcgggtcttgaccatttggagcttgaaggggaacaagtaacagtcggaggcggttattcagtggtccgccttgctacatcattgagcaaaaaaggcctgtccggtttggaatttgctgccggcattccaggatcagtcggcggagcggtttatatgaatgccggcgctcacggttctgatatgagcgagattctcgtcaaagcgcatattttatttgaagacggaacgattgagtggctgacaaatgagcagatggatttcagctacaggacatctgtactgcaaaagaaacgcccgggcgtttgccttgaagctgttttgcagctggagcagaaggataaggaatcaatcgttcagcaaatgcaaagcaataaagactatagaaaaaatacacagccgtattcaagcccttgtgcgggaagcatattcagaaatccgcttccgaatcatgccgggaaccttgtagaaaaagcaggcttgaaaggatatcaaatcggcggtgcaaagatatcggagatgcacggaaacttcatcgtcaatgcgggaggagcatcagcaaaagatgtgcttgatctcattgaccatgtgaaaaagacaatccgtgaaaaatacgagattgatatgcacacagaggttgaaatcatcggcggaaatcgctgattcaagttctgactgaagctgttcatatgatatactgtaagcaaacgacaaacggcatcatagtatgccgtttgttttggaatagacagacttttaacagctgtttcatttgaatgaggtgaacaggcaatgaacccgggtcaagaccgagaaaaaatcgttaacattgaagagcggatccctaaaattaaagagcagaggaaacaaaaggcaaaccgccgtctcatttcatttattatgctcttttttattatggtgctgatcattgtgtacctgcaaacaccaatcagtaaagtatcaacaatctctgttacagggaatgaaaatgtatcaaaaaaggaaattatcgacctttccgatattaacagcggagatactgagttttggagtttggacaagcaaaaaacagaaaagaagattcagcaaaataaattagtgaaaaaagcggagatcagcaaatcgctgcctaataaaatcaacattgcaatcgaagaatataaagcgattgcttatttagaaaaagacgatgtgtactatgaagtgcttgaaaacggctcagttctgccaaacgaagtaacgccggatgatgccggaccgattttagtgaattggacaaacgcgaagaagcggtctcaaatggccaagcagctcgatgcgttgtcaaagtcgttaaaacagtcgatttcagaaatttattatacgcctgtaaaaatggatgaaaaccgtattaagttgtacatgaacgacggttatgttgttacggcatctattaaaacgtttgcagaccgaatgaagacgtatccttctatcatctcacagctaagcagcaataaaaaaggaatcattcatttagaagttgccacctattttgaagagtttgggaaaaacgataaagctgctaaaaaggaagatgaaaattgaggggcaaatcagcagtccttctttccttgattatgcttatcgcaggttttttgatttcattttcttttcaaatgacaaaagaaaacaacaaaagcgcggctgagacggaagagtggaaaaaagaatatgcgctgagagatgaactgctgaaacaagagaaagaaaataagaagtttgaaaaagaattatatcaaaagcaaaacaaagtccgccaggcggaaaataagctgaagaaagagaagtcggaatactataatgtcctcgaagatacagaaaaatacaggatgtatattggggaagtcggtgtgcagggagaaggcgttgaggtgacattggaagatgcgtcatacataccggaaggggagaatgtgaatagttacatcgttcacgaaagccatatcttccaagtagtaaacgaactgtatatctcaggagcggcagctgtcgccgttaatggacagcgtttgacgcatgattcgtatatcaaatgcaatggtcctgtggtaacggtagacggggtgcagcatcccgctccgtttacggtatccgctattggagatccagatgtcctgctgccctcgttaaatatcgctggaggcctaattgatcagctgtcaatggatcatatttctgtgtcggcagaaaaagagaaaaacgtacaaatgaaaccgattctgaaaacgaaggaatgactgaaaaagcgggtgaaatagattgaaaataaagcgttccttcataagcatcagtgttcttatggtcatcttcggcctgatgatatctgttcagtttaattcgttaaagcaccccaaagtccgggatacaagagatatgtgggatattagggaagagctgacatcagagcagaagaagcaggaaaagctgctggctgaaataaacaaatatgacaaattgctgaatagctattcgcaaacgaaagaaatgacaaaagaaaccgcgctaaataataccttgcaatccttaaaaaaaacagccggcatgaccgatataacaggtagcggaattgtcattacgatttccccgcttttttctgaaagcttaacaggagagccgatcgaaaatccgcctccggatttgctgaaaaagctgataaatgaactcaactcctacggtgcagagcatatctcgattaatgagcgaagagttgtgaatcatacagtcatcagagatataaacggcactacaaaaatagacggatacgcccttgacgattatcctttaacagtaaaagtgcttgccaaagatccggacatgttacacagcagagtgaaggggtcaggccttgaggatctttttgcatctgaaaatttagcattaaaagccggtaaatctgaaagcaaactaatattaaaagcatatgacagaccactggacgtacaacagctgaaactgcttaaagactgaaaaggaggagaattgtcatgtggctgcccgtgttgggactggtgctcggaatagcgattggactaatgacaaacttaacgataccgagtgaatactcaaactatttatcgcttgcggtgcttgccgcacttgatacattaatcggcggaatcagggcgcatttacaaggtacatatgatgaaatggtatttgtttccggtttcttttttaatattatattggcaataagtttagcttttctgggagtccatcttggtgtagacttgtatttagcaggtatattcgcatttggagtcagattatttcagaatatagccgttatcagaagaaatctactaacaaagtggactctttctaaaaaaaataaaaaaaatgtgatataaaagaggatatacataggatataacgaatattttcaataaacataaaatgtgaaaagcacataaaaatattctgttgttattttttgttacacacttgtaaagccacattcattgtattgttgttccgcaaataatagaatagaaatgatcgaaatgtgaggaggtgccatagaatgaacaacaatgaactttacgtcagtcttgacatcggtacgtccaatacaaaagtgatcgtcggagaaatgacagatgattcccttaatattatcggtgtgggaaatgtaccgtctgaagggttgaaaaaaggctcaatcgttgatatagatgagaccgttcattctataagaaaagcgtttgaccaagctgaaagaatggtaggttttccgcttagaaaagctattgtcggcgttaatggaaattatatcaatattcaagatacaaacggtgttgtagcagtttccagtgaaaataaagaaattcaggttgaagacgtacgccgtgtcatggaggcggcacaggttgtttcagtaccgcacgaacagctgattgtcgatgttattcctaaacagtttatcgtagatggaagagatgaaatcaccgacccgaaaaaaatgctgggggtgcgtttagaagtagagggcaccttgatcaccggttcaaaaacaatcttacataatttactccgctgcgttgaaagagctggtattgaaataactgatatttgccttcagccgctggcagccggttctgctgcattatcaaaggacgagaaaaaccttggtgtggctctcattgatatagggggagggtcaacaaccattgccgtattccagaacggacatctcacttctacccgtgtcattcctctcggaggcgaaaatatcaccaaagatatctccatcggattgagaacgtcaacagaagaagcagaacgcgtgaaaaagcaatttggacatgcctactatgacgaagcctcggaagatgaaatttttgaggtaaccgttataggcaccaatcaaaaacaaacatttacacagcaagaagcagcgaatatcattgaagcgagagtagaagaaattcttgaaattgtttcagaagagcttcgcagtatgggaattaccgatctgccgggaggcttcgtgctgacaggaggacaagcagctatgccgggtgtcatgtctttggcacaggatgtgctgcaaaacaatgtcagagtggcaagcccgaattatatcggtgtaagagatcctcaatatatgacgggagtgggcctgatccaattcgcctgccggaatgcaagaatccaaggcagaaaaataggctttaagatgcctgaagaagcgatacaggaaatcgcagtctcatcatctgaggaacaagagcagcatcatcaccaaaatgaggtgcagcagcggccaaaaggaaaacaaaaaacacaagccgaacataataaacagagcaaaatgaaaaaactattaagcatgttttgggaatagatagatagtcattcggcagattaggaggatttagcatgttggagttcgaaacaaacatagacggcttagcatcaattaaagtaatcggagtaggaggcggcggtaacaacgccgttaaccgaatgattgaaaatgaagtgcaaggagtagagtatatcgcggtaaacacggacgctcaagctcttaacctgtcaaaagcagaagtgaaaatgcaaatcggcgcaaagctgactagaggattgggagcaggtgcgaatccggaagtcgggaaaaaagccgctgaagaaagcaaagagcagattgaagaagcacttaaaggtgctgacatggtattcgtgacagctggtatgggcggcggaacaggaacaggtgccgcaccggttatcgcacaaatcgcgaaagacttaggcgcattaactgtcggcgttgtgacaagaccgtttaccttcgaaggacgcaaaagacagcttcaggctgcaggcggaatctcggcaatgaaagaagcggtggatacactgatcgtgatcccgaacgaccgtatccttgaaattgttgataaaaacacaccgatgcttgaagcattccgtgaagcggataacgtacttcgccaaggggttcaaggtatttctgacttgattgctacacctggtcttatcaaccttgactttgctgatgtgaaaacaatcatgtcaaacaaaggatctgctttgatgggtatcggtattgctactggggaaaatcgcgcggcagaggcagcaaaaaaagcaatttccagcccgcttcttgaagcggccattgacggtgcgcaaggcgtcctcatgaacatcactggaggaacaaacctcagcctatatgaggttcaggaagcagcagacattgtcgcttcggcgtctgatcaagacgtaaacatgattttcggttctgttattaatgaaaatctaaaagatgagattgtggtgacagtgattgcaaccggctttatcgaacaagagaaggacgtgacgaagcctcagcgtccaagcttaaatcaaagcatcaaaacacacaatcaaagtgttccgaagcgtgagccaaaacgtgaggagcctcagcagcagaacacagtaagccgtcatacttcacagccggctgatgatacgcttgacatcccgacattcttaagaaaccgtaataaacgcggctaatgtaaaggacaaaatcgttttcgattttgtccttttttgtttttctcttcacactttccttcttataaagtctttttccctattgcttccttcgcttagtaacaaaacagataattagatctatttatttttgtgacatttttatcattttcatatatttggaaattgaatgacatgaaacgacaatatctgtaattcagattgtctacagttaatatacagcgatgttctgacaaaccattcattattaaaaggagggacgacactttttttaaaaagcatgttgaaaaagggggatgaaaatgaagaaaaaaacgaaaaacagactcatcagctctgttttaagtacagttgtcatcagttcactgctgtttccgggagcagccggggcaagcagtaaagtcacctcaccttctgttaaaaaggagcttcaatctgcggaatccattcaaaacaagatttcgagttcattaaagaaaagctttaaaaagaaagaaaaaacgacttttctgattaaatttaaagatcaggctaacacagaaaaagcggcaaaagcggctgttaaaaaagcgaaatcgaagaagctgtctgccgctaagacggaatatcaaaagcgttctgctgttgtgtcatctttaaaagtcacagccgatgaatcccagcaagatgtcctaaaatacttgaacacccagaaagataaaggaaatgcagaccaaattcattcttattatgtggtgaacgggatcgctgttcatgcctcaaaagaggttatggaaaaagtggcgcagtttcccgaagtggagaaggtgcttcctaatgagaaacggcagctttttaagtcatcctccccatttaatatgaaaaaagcacagaaagctattaaagcaactgacggtgtggaatggaatgtagaccaaatcgatgccccaaaagcttgggcacttggatatgatggaactggcacggttgttgcgtccattgataccggtgtggaatggaatcatccggcattaaaagagaaatatcgcgggtataatccggaaaatcctaatgagcctgaaaatgaaatgaactggtatgatgccgtagcaggcgaggcaagcccttatgatgatttggctcatggaacccatgtgacaggcacgatggtgggctctgaacctgatggaacaaatcaaatcggtgtagcgcctggcgcaaaatggattgctgttaaagcgttctctgaagatggcggcactgatgctgacattttggaagctggtgaatgggttttagcaccaaaggacgcggaaggaaatccccacccggaaatggctcctgatgttgtcaataactcatggggagggggctctggacttgatgaatggtacagagacatggtcaatgcctggcgtgcggccgatattttcccagagttttcagcggggaatacggatctctttattcccggcgggcctggttctatcgcaaatccggcaaactatccagaatcgtttgcaactggagcgactgatatcaataaaaagctcgctgacttttctcttcaagggccatctccatatgatgaaacaaagccggaaatatctgcaccgggcgtaaatattcgttcatccgttcccggtcagacatatgaggatggatgggacggcacatcaatggcagggccgcatgtatccgctgttgctgcactgctaaaacaggcgaatgcctcactttctgttgatgagatggaggatatattaaccagcacggctgaaccgctcacggattcaacatttcctgattcaccgaataacggatatggccatggtctggtgaatgcttttgatgctgtatccgctgttacagatggtttagggaaagcggaaggacaagtttctgtagagggggatgaccaagagcctcctgtctatcagcatgagaaagtaactgaagcttatgaaggtggcagcctgccattgactttgacagctgaagacaatgtgagtgtgacatctgtaaagctgtcctacaagcttgatcaaggtgaatggacagaaataacggctaaacgaatcagcggtgatcatctaaaaggaacgtatcaggcagagatcccagatataaaaggaactaaactaagctataagtggatgattcacgattttggcggtcatgtcgtttcgtctgacgtatacgatgtaacagtgaaaccaagcatcacggcgggatataagcaggactttgaaactgcacccggcggctgggttgcgagcggaacaaataataactgggaatggggagttccgtcaactggcccaaatacagcagcatctggagaaaaagtatatggaacgaatttgacaggaaattatgccaactcagcaaacatgaaccttgttatgcctcctgttaaagcacctgattcaggaagtctgttccttcaatttaaaagctggcacaatttagaggatgattttgattacggctacgtttttgttcttccggaaggtgaaaagaattgggagcaggctggtgtctataacggaaagacatcaagctggacggacgaagaaattgatttatcggcttataaaggccaaaacattcaagtgatgtttaaccttcaatctgatgaaagcattgcaaaagagggctggtatattgatgatgtagtgctttctgacaaatcagccggaaaaacagtcaaaaagaataagctgggcgtcgaaaagccgtctggaaagcaaaagaaaaagccagtaaatccgaaaaaggctaagccatctgcaaacacagcggtaaaacatcagaacaaggctatacagcctcaagttttgccgctcagggcacaagtcagtgtagtggaaacaggaaaatcaacatattcagatcaatccacagggcagtacacgctgaagcacaaagcgggagactatacgcttatggcagaagcatatggttatcagtcgaaaacacaaaaagtatctttaaagacggatcagacgacacaagctaattttacgttagaagagatgaagaagggcacattaaaaggcacggtcatcaataaaacgacaggagagccggtaacaggcgcttccgtttatgttgtagaggatgctgcggtggaaccggctatgacaaacgacaaaggtgaatatacgctggaggcctatgaaggcgcttatacgattaaagtcgctgcaccgggttattacagtgatgaattttccgttgagttaaaaggtgatgttacaaaagaaactgcattgaagcctttcgtcggttatccgggtgaaattgcatatgatgacggaacagcggagaatgccaattcctattttgctgccggtaacggatgggcggtaaaaatgacgctcgctgacggcaaggacaaaggcatgcttacaggagggctgtttagattctgggatacagagttcccagatccgggcggcacagagtttaaggttgaggtatacgatgccacaggaaaagacggagcaccgggcaagaaaattgccgggccatttaacgctgaagctcttcgcaatggcgagtggactaaggtagatctcagttcaaaagggattatggtcgataaagacttttatctcgtatatatccagtcgaaacctgacccgtattcacctggactggcaatggatgaaaccggcaagaattccggccgcaactggcagtatataggtggacaatgggagccgggtgacaaagcagacggcaactatatgattcgcgcattagttgattacgaagctgctgtacctgagattacttcaccgacagacaaatcatacacaaataaggatagcgtcactgtaaaaggaaaagcttctcctggtacaacggtacacatttataatggagagaaagaggcaggagaaacgaaagccgctgcggatggcacgttccatgcaggcatcacactcaacaagggtgaaaatgagctgacggcaactgcatcaactgacaacggaacaacagatgcctccagcccaatcacggtcacgcttgatcaagaaaagcctgagttaacgctggacaatccaaaggatggcgggaaaacaaataaagaaacgctgactgtcaaaggggctgtatccgatgacaatctgaaagacgtcaaggtgaatggcaaaaaagcaacagtagctgatggttcatactcagcccgtattcttttggaaaatggaagaaatgaaatcaaggtgattgctacagacttggcaggcaacaaaacgacgaaaaagacagtcattgatgtgaactttgacaagcctgtcatttccggcttaattccgggagaggataaaaacttaaaagccggtgaatctgtgaaaatcgctttttcaagcgctgaggatttagatgcaacgtttatcattcgtatgccgctgacaaatgcaagagcgagtgtgcaaaacgccatcgaactcccgttaagagaaatttctccgggaagatatgaaggctattggacagccacttcttctattaaagcaaaaggagcaaaagtagaagtaatcgtacgagatgattatggaaatgaaactagaaaaactgcaaatggaaaacttaatatcaacacagaaaattaagtggaataaagctgccgtcattggcagcttttttatatatcctctcattacacttcctcgacaaattaagcagatttccctgaaaaattgtattttcctctcaacattaattgacagactttcccacagagcttgctttatacttatgaagcaagaaggggaacagcgtgaggcaagaaagaaaggagtcagatgtgaaaatctatttagatgtcatttggctgttaaacttttgttttgatgcacttttgcttttgctcacggcatttattttaaaacggcatgtaaaaaaaagaagactggtaggcggagcgttcatcggttccagtattgtccttttgatgtttactcctttttcgccgattgttgaacatccggctgggaagctagctttttcagttgtgattgtggtggtgacatttggctttaaaagatttcggtttttctttcaaaatttgttttccttttattttgccacttttttaatggggggaggaattatcggagcccattctttgctgcagtcaaattctattgttcaaaacggtgtcatgattaccaatcaaacagggtttggagacccgatcagctggttgtttattgttggtggctttccagcattatggtttttttctaaaagaagaattgaagatattgaaacaaaaaacattcaatatgaggaacgagtcagcgtgcaggcagatttgggcaaccaaacacttcatgtcagaggcctgattgattccggtaatcagctgtatgatcctcttacaaaaacaccggtaatgatcatttacattgataaactggagccgattttcggaacagccgaaacgatgatcattcgaaacacagacccattggaagccatcgaacagctcgatgattcctttcgctttttagataaaatgaggttgattccatacaggggagttggtcagcaaaatcaatttttattatgcgttaaaccggatcacgtaacgattatgacaaaagaagaaatgatttctgcagataaatgtttaatcggcatcagcacaacaaagctgtcggcagatggagagtttgacgcgattattcatccgaaaatgctttcgggcaaggctgtcaaacacgtttcataatgttcgcaaatgtccgttacttatcatactcaaacgacgtgacatttagaagggagaggaagatgaaaaaactgaaattacggttgacgcacctctggtataagctgctgatgaaacttgggctgaaaagtgatgaagtctattacataggcgggagtgaagccctgccgcctccattatctaaagatgaggagcaggttttgttaatgaagctcccaaacggcgatcaggcggcgcgcgccattctaattgaacgcaatttgcgtctggtcgtatatatcgcccgtaaatttgaaaatacgggaattaatatagaggatttaatcagcatcggtaccatcggtctaatcaaagctgtgaatacattcaatccagaaaagaaaatcaagcttgctacctatgcctcccggtgtatagaaaatgaaatcctgatgtatttaagaagaaataacaaaatccgttcagaggtttcctttgatgaaccgcttaatattgattgggacggcaatgagcttttgctttctgatgtgctcggcactgacgatgacatcatcactaaagacatagaagctaacgtcgataaaaagcttttgaaaaaagcgcttgaacagcttaatgagagagaaaagcaaatcatggagctgcggtttgggcttgtcggtgaagaagaaaaaacccaaaaggatgtagcggatatgatggggatttctcagtcttatatttcgcggcttgagaaaagaattataaaaagattgagaaaagagttcaacaaaatggtgtaaaaaattttatggttagaaccccttgattttacagggatttcctgatttcgacagtttttcggtctgagtgcagtgcatatttttcccacccaaggagatacttaacgttgtacagcagctcctgtagggagggaaaaaagtgtcgagaaataaagtcgaaatctgcggggtggatacctccaaattaccagtactcaagaatgaagagatgagaaagctgtttaggcagctgcaggatgaaggcgatgattcagcaagagaaaagcttgtaaacgggaacttgcgtcttgtcttaagtgtcattcaacgatttaataacagaggggagtatgttgatgacttatttcaagtcggctgcatcggactaatgaaatccattgataattttgacctaagccacaatgttaagttttcaacatacgctgtacctatgattatcggagagatccgcaggtatttacgtgataataacccgatccgtgtctcaagatcactccgggacatcgcttacaaggcgcttcaggtaagagagcggttaatcagtgagacaagcaaggagccgactgcagaagacatcgcaaaagttcttgaagtaccgcatgaggaaattgtatttgcgcttgatgccatccaggatccggtttctctatttgaaccgatctataacgacggcggagacccgatctatgtgatggaccaaatcagtgatgagcgtaatacagattcacaatggattgaagagctggctttaaaagagggcatgagaaggctgaacgatagggaaaaaatgattttgagaaagcgattcttccaagggaaaacccaaatggaagtcgccgaggaaatcggaatttctcaagcgcaggtgtccagacttgaaaaagcggctatcaaacaaatgaataaaaatattcatcaataatgaaaagcctttaaaacgatgttgttttaaaggcttttctattgattacggatggtttacgttttgggaaaagtaaggtatcctagttcgtacaaagttttatgaaaattaaaacaattataaaaggcaataaagaggaggaccacgatgattttgcagcttgacaatgtctcactaaaacggaatgggaaatggatactgagagatattcattggaaggtggaagaaaaggaaaattgggtgctttacggcctaaatggcgccgggaagacagcgctgttaaatatgctttgctcttattattttccaacatcaggcgagatgcaggtgcttggccatgaatttggcaaaacagagcttggggaaaagctcagacgtaaaattggcctcgtctcagcagctcttcagcaaaaattgtatccggcagattcagcctttgaaattgctttgagcggagcttacgcttcgattgggttatatgaaacgccaagtaagaaaaccagggaaaaagcgattggtttgttagaggacttgggagcaattgaatatgccgatcgccgctatgaaaccctttctcaaggggaaaaacaaagagcgttgattgctagagcactaatggccgatccggagttgctgatactggatgaaccagtcacaggactggattttattgcccgggaaaagctgttagatacgattacatacattgcaaacaaagaaaatgcaccatctatcctttatgtgactcatcatgctgaagaaattttgcctgtctttgataaagcccttttattaaaacagggagaggtctttggatccggagaaataaaggaaatgcttactgatcaaatactttccgctttttttgatacgccaatccatgtattatggaatcaggatcggccgtttttaactagagctgagccgataacgaatgcctgacaaatatatatagattcatcctaggggtgctttgcgaagctgagagagactttgtctcaacccttttgacctgatctggatcatgccagcggagggaagcggtgaaaagcggagtacatcggactccgtttgtttttattaagccgtttcatcacatttgaaacggcttatttgattttaaagaataggagcggatttacattggatcaacaaatagactctttgcaaaaaaaagtggaagaacataaggaggagcttattcagcttgcgaaaacgctaatttcttatcaaacacctgctccgcctgcaagaaatacagagggcattcagtcatggattgcgggatatttaaatgaattgggattctcgatcgacaaatgggatgtgtaccctggagatcccaatgttgtagggaagctaaaaggaacagattcagcagattattatagcctgattatcaatggccatgtagatgtggcagaggtaaaagaggatgaagaatgggagcatgatccatttcatccaattgaaaaaaacggtctcttaatcggtcgaggcgcttccgatatgaagggcggaatggcttgtgtgttgtttgctgtcaaattaattcgtgaagcaggcattgaacttcccggtgatctgattctgcaatcggttatcggggaggaagttggagaagccggcacgcttgaatgctgcaagaggggctaccacgctgattttgcaattgtagcggatacgagcgatatgcatattcaaggccaaggcggtgtcattacaggctggatcgaaatcaaaagcagtcaaacatttcatgatggaacgagacggaatatgatccacgcagggggaggaacattcggagcaagcgcaattgaaaaaatggcgaaaatcattgcggggctcggtgaacttgagcgccactggtctattatgaaaagttatcccggctttaaacctggaacaaatacaattaacccggctgttatagaaggcggcagacatgcggcttttatagcggacgaatgccggctgtggatcacagtccatttttatccgaatgaaactcatgaccaagtggcagcggaaatagaagattacgtcaatcggctgagtgacagtgatatttggcttagggaaaaccgccctgtattcaagtggggaggctcatctatgatagaagacagaggagaaatttttccggcattggaagttgaccctggccacccaggcgtcttagcgctaactgcctctcatcagaaagtgaaacgggagtgtccaattattgacgtttctcaatcagttacagatggcggatggctgtatgatgccggtattccatgcgtaatatacggtcctggagatctgcacaatgcacactctgtgaacgagaaggtatcgattgagcagctagtagagtatacaaaaattatactcgattttatcatcagctggtgcagccggaaaaaagagcaatgacatgaaaatttcttcttgctgacaaggttcagcctgcccgttcatatacttgaacaaaaggacggaaaaaggacgtgatggaatgatcagcatttcagaatttcaggtaaaggatgtcgtcaatgtctcaaacggaaaaaagctggggagtattggtgatattgatatcaatgtgactactggaaaaattcaggcgatcatactcggaggaaatgggaaagttctcggattttttggaaaagaagaggaattggtcattccatggcgaaatatagtaaaaatcggggaagatgtaatcttagtccgattaagtgaaccgcatgcataaacctgcttgtctgccgcagattggcaaatgccggaagtctcgattcttccggcacatttcatttagaaatatgcaaatcggcgctcaacgaatgcagtaagatgtggtaaaataagtgggaaattccgcttttttaaatgtttgtcgaaaggttggatcatcatgaatacatatcacccattcagtcttaccacaccctcgacactcatgatacaagactgggctcaaacgaatcaaaacaacaaagaggtcattgccggatttacgacaaaaaacggcggtgtcagccaaaagccttttgaatcgttaaatacaggattgcacgttcatgacaaagatgcagatgtagttaaaaatcgtgaatatattgccgatatgtttaatactgatttgcagtcttgggtattcgctgatcagacacatgataatcgcgttcagaaactgacgcagagggataggggaaaaggcgcccgtgagtatcacacggctctaaaagcaacggacgggctctatacaaatgaaaaaaatgtatttttagcattatgctttgctgattgtgtgcctcttttcttttatgatccggttaagtcgcttgtcggagtcgcccatgccgggtggaaaggcaccgtcaaacagattggcagagaaatggtgaaacaatggactgagaaggaaggttcaaatccctcagatatttacgctgttattggcccgtctatcagcggtgcatgctatacggtagacgaccgcgtaatggatgctgtccgcgcattgccggtttcagcagaccttgccgttaatcagacggcaaaggcacaatatcagcttgatctgaaagagctgaaccgtcttatactgatggacagcggtttggcaagtgaacaaatttctgtcagcggtttatgcacggaaagcgagccgtctcttttctattctcaccgccgcgatcaggggaaaactggacggatgatgtcctttatcggaatgaaggaggcataaaagatcttgcgtgttgttgataatttacgacatataaacgaacgaataaacgaagcatgtaacagatcgggccgcagctccgatgaagttacggttattgcagtcactaaatatgtatcgcctgaaagagcacaggaggcagtagatgctggcatcacctgcctcggagagaatcgggatgcggaactgctccgcaaacagggattgatgaaagggaatccggaatggcattttatcggcagtctgcaatcaagaaaagcaaaatctgtcgtcaatgcggtttcctatatccattccctagaccggctctcattagcgaaagaaattgaaaaacgggctgaaggtactgtacgatgctttgtgcaggtcaatacctctcttgagccttctaaacacggcatgaaaaaagaagaagtcattccattcatacaggagctttccggtttcgaacatatccttgttgccgggctgatgacaatggctccgctgactgatgatcaagatcagatcagaagctgtttcaggtcgctgagagaactccgtgaccaggttcagaagctgaaccagccgaacgctccgtgtactgaactgtcgatgggcatgtcaaatgattttgaaattgcaattgaagaaggagctacttatattagaatcggctcatcgttagtcggaaatgaaacagggggtgtacagcaatgagtatgaaaaataaactgaaaaactttttctcaatggaagatgaagaatacgaatatgaatatattgagacagagcgggaatctcatgaggagcatgagcaaaaagaaaagccggcttatacggggaataaaccttcgggcaaacagaatgtagtgagcttgcaaagtgttcagaaatcctctaaagtggtgttgagtgagccgcgcgtttatgcggaggcgcaggaaatagccgaccatttgaagaaccggcgggcagttgtcgtcaatcttcagcggatacagcatgaccaggcgaagcggattgttgactttttaagcggaaccgtttatgccattggcggcgatattcaaagaatcggctcagatattttcctctgcacgcctgacaacgtagatgtatcaggcacaatttctgagctcatatctgaagacgaacatcagaggtggtaaagcgagatgatcctttatcaagttttttcggttttaagcttattaatcacaatatactcatttgccctgatcatatatatttttatgtcatgggtgccgagtacgagggaaacagcagtcgggcgttttttggcttcgatttgtgaaccatatctcgaaccattcagaaaaatcattcctccgattgcaatgctggatatttcaccaatcgtagcaatacttgtgcttcggtttgcgacaaccggcttgtggggactttatcgcatgattgcgttttaatgtgacagtttgataggggcttggcagcagccaagcctctttacatagaagggaaagacgatgagcgatatatatcagcacttcagaaaagacgagcgggcctttattgatcaggcgctcgaatggaaaagaattgtccaggagcagtaccggatgaagctgaccgactttttagatccccgagagcaggtcatcctctctgctgttacgggacaggctgacgtcgggcttgctttttccggcggctatgacagagcggagcggaaacgggcgattctgtatccagagtacattactccggaagaatcggattttgaattgcaggcgtttaacgtccgttatgctgacaagtttgtctcagtagatcatcgttctctgcttggtgcattaatgggcataggattaaagcggcaaaaattcggtgacatcgtgttttctgagacagcagtgcaattgattgtctcagccgataccgctgattttgtggctgcacagctgacccaagcaggcaaagcggcggtcagcctagagaaaatcgacttgtcagaccttaacattccagcagttgatgtcgaaataagagatgacacggtttcttctttaaggcttgacgccgtctgcgcctctatgaacaggcaatcccgccagaaatcacagacgcttgtgaaaaacggcctcgtgaaagtgaactggaaggtggttgaagatccttcatacatagtcgcggaaggggacatgctgtctatcagaggttttggccggtgcagcttaacaaaaatcgaagggaaaaccaaaaaagacaaatggagagttacgtttgaacgacaaaaatagtcggtttttcagtttttttctccatctgtgcgaaatttgttttataatgtgaactagataaccgtactgaaatgtaaaaatggaggtggcatcatgccattaacgccaaatgatattcacaacaagacgtttacaaaaagttttcgcggatatgatgaagatgaagtaaatgaattcctagcccaagttagaaaagattacgaaattgttctccgcaagaaaactgagcttgaagcgaaagtcaatgagcttgatgaaagaatcggacactttgccaatattgaggaaacattgaataaatcaattttagttgctcaagaagcggctgaagacgtaaaacgcaattctcaaaaagaggcaaagctgattgttcgggaagcggagaaaaacgctgatcgcattatcaacgaatcgttatcaaaatcaagaaaaattgcaatggaaattgaagagctgaaaaaacagtctaaagtgttcagaacacgtttccaaatgctgattgaagctcagcttgatcttctgaaaaatgacgattgggatcatctccttgagtatgaagtcgacgctgtatttgaggaaaaggaataaattctctgattatcttgacattttcttagcttgtcgaatataatacgttcataaattcagatgaaaaaacggttgaaagggacagtcatgtttccttcaggccttcatagcgacccggagatggtgagagtccgggatggccggaatcatgtagatcagccctttagtttccttgctgaactcacagtaggttaggacgttcatcacgttacgatgctcaagaggaaaaagcgtatgcttgctttttctaaaagggtggtaccgcgagataagctttctcgtcccttatgggatgagagggctttttttattttctgaaaaaatgcagtggaggaatgaaaatggattttaaagacacgctcttaatgccaaaaacagatttcccgatgcgtggaaatttgccaaaccgtgagcctgacattcaaaaaaaatgggaggaagaggatatctaccgtcttgttcaggaacggacgaaagaccgcccgaaatttgttttacatgacggacctccgtatgcaaacggcgacatccatatgggccatgcacttaacaagattttgaaagacttcattgtccgctataaatcaatgagcggctacaacgcaccgtatgtaccgggctgggatacacacggattgccaattgaaacagctctgacaaaaaacaaaaaagtcaaccgcaaagaaatgtcagtagcggaattccgcaaactgtgcgaagagtacgcttggaagcaaatcgagggacagcgtgagcaatttaaacgtcttggtgttcgcggtgactgggaaaacccatatgtgacattaaaaccggaatacgaagcgcagcaaatccgcgtatttggtgaaatggcaaaacgaggctacatttacaaaggccttaaaccggttaactggtcaccttcaagtgagtctgctctggctgaagccgagatcgaatatcaagacaaacgttcagcatcaatttacgtcgcttttggtgtaaaagacggaaaaggcgttcttgaaaacagcgagcgcatcatcatttggacaacaacgccttggacaattccggcgaacctcggaatctcagtgcaccctgatcttgagtacagcgtgattgcagtaggtgaagaccgctttgtcgtagcaagtgccttagtcgaaaatgttgcatcggcatgcggatttgatcagtatgaagtgacaagaacggtcaaaggaaaagaccttgagaacattatcgctgaacacccgctatatggcagagactctctcgttatgcttggtgaacacgtaacaactgatgccggaacaggctgtgttcatacagcgccaggacatggggaagatgactttatcatcggccaaaaatacggtttagatgtgctttgcccggtcgatgaaaaaggtgtaatgacaagcgaagctcctggctttgaaggcatgttctatgatgatgcaaacaaagcgatcacacagcagcttgaagaaaaaggcgcacttgtgaagcttgaattcattactcactcttatccgcatgattggagaacaaaaaaaccaaccattttcagagcgacagcgcaatggtttgcgtctattaaagatttcagatcagacctgctggatgccattaaagaaaccaaatgggttcctgaatggggcgagcagcgtttgcacaacatggttcgggaccgcggagactggtgtatttccagacagcgtgcgtggggtgtgccgattccggtattttacgctgaaaacggagaaccgattattacagatgaaaccattgaacatgtttctgaattgttcagacagcacggatcaaacatttggtttgaaaaagaagcaaaggatcttcttccggaaggctttacgcatcctggcagcccgaacggcacatttacaaaagaacaggatatcatggatgtttggtttgattcaggctcttcacatcaagcagtgcttgaagaacgtgatgacctcgttcgcccggctgatttatacctagagggatctgaccaatatcgcggctggtttaactcttctctttctacagcagtagccgtaacagggaaagcgccgtataaaggagtgctcagccatgggttcgcactggatggagaaggacgcaagatgagtaaatcaatcggtaacgttgttgttccggctaaagtcatgaaacagcttggtgccgacatcttaagattatgggtatcttcagtggattatcaggcggacgttcgtgtgtctgacgccattctaaagcaggttgcggaagtatatcgtaaaatccgcaacacgttccgtttccttcacggcaaccttttcgattttgatccaaaaacaaatgcggtggctgtcgaagatcttcgtgaagtggatcagtatatgctgattaagctgaacaagctgattgataaagtgaaaaaagcgtatgatgagtacgaatttgcggttgtgtatcacagcattcataatttctgcacaatcgaattgagctcattctaccttgattttgcaaaagatattgtctacatcgagcatgcggatcatccggatagacgcagcatgcagacagtattctacgaaacgcttcttgcattagtgaagctttctgcgcctatccttccacatacggcagacgaattgtggtctcatttaacatttgttgaagagcagagcgttcagctgaccgatatgccggaaacaatcgcggttccaaacagtgaagtgactgaagaaaaatttgaccgctttatggctcttcgtgatgacgtgctaaaagcattagaaactgcgcgaaatgaaaaaattatcggtaaatctttggaagcaaacctgaaattgtatccaaacaaagaaaacaaagagctcttggcttccataaaagaaaacctttctcagctgtttattgtgtctgagctgacaatcagcgaagaaaatgaagcgccgaacgatgcgcaaagctttccgacgggtaaaatcgctgttgagaaagcggaaggcgaaatgtgtgagagatcacgtgtgatttcaaaagatgtaggtgcaaatccgaaatatcctacactttcattacgcaacgctgaaatcgttgaaaaatactatcaaaaataatgaaaagggcccggcgtaaaagccgggctttttttgtgccaagagtgacatcctttagaacggcaggaaaaatcttatgggctttagatcatcattcataggcaacaataaaggtactacgttaagagcaggagttgtgaagaatgaatgatcaactgaccgcaatttatacggaacttcttctgatgaaagaagaattacagtcgagattatttgagtattcttgctttcaggtttctacaagcccgcaagcagcaatcaatcataaacaaaaagcaactctgatctatcatattaaagaagagcttcaagacgttctccttgcattgtccaaaatcgaaaacggcacattcggatactgtgaagaaacaggggcccccattcctcttgcaaagctggcagtgctgccgactgcccgaacagcaaacgattttctttattctgtccaatttgagaaaaaaacgcttccgatatggaaatcaacggatatcgaatatggtcaggcactgtatgaataacagtgtctgtccggttaatatgcctgatatttctttactccagtgctttttattgataaaatgcataatggattaaagtaaccgtaaactggaggaacgtttgtgctgtattatatgattgcactacttattattgcagccgatcaattgacaaaatggctagttgttaagaacatggaacttggccaaagcattccgatcattgatcaggtattctatatcacctcccatcgcaatacgggtgctgcatgggggatattagcgggtcaaatgtggtttttctacctcataacaaccgctgttattattggtattgtttattacatacagcgttatacaaagggacaaaggcttcttggcgttgccctcggacttatgcttggcggtgccatcggcaactttatcgatcgggctgtcagacaggaagttgtggattttatccatgttattattgtcaattacaattacccgatatttaacatcgcggactcttcattatgtgtcggcgtaatgcttttatttatacaaatgctgttggacagcgggaaaaagaaaaaggagcaatagcatgaatcaaattgatataaccgcttcagaagaacaaaaaagtgagcggattgataaatttttggcatcgactgagaatgattggtcaagaacccaggttcagcaatgggtaaaagacggacaggttgtcgtgaacggaagcgcggtgaaagcgaattataaaattcagccgggtgatcaggtgaccgtcactgtacccgaaccggaagcgctcgacgtcttggcagaacctatggatctggatatttattatgaggaccaggatgtgctggtcgtcaacaaacctcgcggaatggttgttcacccagcacccgggcatcttacgggcacacttgtaaacggccttatggctcattgcacagacctttccggaataaatggtgtgatgcgtccgggtattgttcacagaatcgataaggacacgtccgggttattaatggtggcgaaaaatgatatggcgcacgagtcactcgtaaaccaattggtcaacaaaacggtcacccgaaaatatacggccgttgtccacgggcttatttctcacgatgacggaacaattgacgcgccgatcggacgagataagaaagaccgtcaaagcatgactgtgacacgtgatggcaaaaacgctgtcactcattttcatgtactagagcgttttcaggattttacgttagtggaatgccagcttgaaacagggagaacccatcaaattcgtgttcatatgaaatatatcggattcccattagcaggcgatccgaaatacggcccaagaaaaacaatcgactttaatggccaagcgcttcacgcgggagttttaggttttgaccatccacgaacaggagaatatgtcgaatttgaagcgccgcttcctgaggatatggcagaattaatcgaaaacctcagaaaaaacggttgacagagggtttcttttctgaaataataaacgaagctgaatagattctttaaaacagtccagagaggctgagaaggataacggatagacgggatgcgtgtacaggcgcgcaccttgtcctaaaacccctctatgctctggcaggaggggttttttcttctatatgaactgtgaggtgtcacacattgaatcaaaaagctgtcattctcgacgaacaggcaatcagacgggcgctgaccaggattgctcacgaaatgatcgaacgcaataaaggaatgaataactgcattcttgtcggtattaagacaagagggatttacctggcaaaacgccttgcggaacgcattgaacagattgagggaaatcctgttacagtcggtgaaattgatattactctttacagagacgatctttctaaaaaaacgagcaacgatgaaccgcttgtaaaaggtgcagatattccggtagatattacagatcaaaaagtcattctcgttgatgatgttctgtataccggaagaacagtcagagcaggaatggatgcgcttgttgatgtaggcagaccttcctccattcagcttgcagtgcttgtggacagaggacaccgggagctgccgatccgagcggattatatcgggaaaaacatcccgacatcaaagtctgaaaaggttatggttcagcttgatgaggtagaccaaaacgatctcgtcgccatttatgaaaacgaataatagatcacctttttaagggcaatccagagaggttgcaaagaggtgcacaacaaaggcccaaaaagcattcggcaggtctttgtatgcctctttgcgtaaaaaagcaaagaggtttttttatacagtcattgagtcatcctaaaatgaaagtcaacaatcagggggaaatcatcatgagtaagaaaaaagtaaatttaggggtcagggatgtcccgacacctttctcttgggtttcattcagccttcagcatttgtttgccatgtttggctcaaccattttggttccgaagctcgtcggaatgagtcctgctgtggcgttggtgacaagcggcatcggaacactggcgtaccttcttattaccaaaggacaaattccggcgtatctcggttcatccttcgcctttatttctccgatcattctggtaaaagcgaccggcgggccgggagcggcaatggttggagcatttcttgcagggctggtgtacgggctgattgccttattgatcaggcagcttggaacaggatgggtgatgaagattctcccgcctgtagtcgtagggcctgttattatcgtcatcgggctgggactggcaagcactgcggtaaacatggcgatgtatgctgatccaaacgcgagtgagttggtctacagcttaaagcactttagtgtcgcaggagttacgctggcaatcacgattatttgtgcgattttcttacgaggatttttaagcctgattccggttctgatcggaatcatcggcggatacctgtttgcccttactcaagggattgtcaacttccagccggtgcttaacgcgaaatggttcgcagtgcctgaatttatcattccgttcaaagattattcaccgtcagttacactcggcatcgcagccgcaatggttcctgtcgcatttgtcacaatgtcagagcatatcggccaccaaatggtgctgagtaaggttgttggacaagatttcattaaaaagccgggactgcatcgctccattatgggtgacagcgtggcgacaattcttgcttccctgatcggcggcccgccgacaacgacttacggagaaaacattggcgtgctggccatcacaagagtattcagcgtctttgtcataggaggcgcggcagtgattgccctttgcttcggctttatcggcaaaatttcagcgctgatcagttcagtgccgtcagcggtcatgggaggcgtctccttcctgctgttcggaatcattgcttcaagtggcctgagaatgctgattgacaacaaaattgattatgaaaacaacagaaacctcattattacatcagttatccttgtcatcggtgtaggaggcgcttttatccaagtgtctcaaggcggattccaagtgtcaggaatggcgcttgccgcaattgtcggtgtcatcttaaacctgattcttccgcaggcgaaggaagagcaggcagacacatctgaacaacatcatatctaaaaccttttaatgaaagtccagagaggcttggaagggttatgaagagaaggaagcttcaatgctgccctctatttaaccgtaccccgagtctatcttagaccggggtttttttcagccttaagttgaaaagagaggggaaagaacatgaagcatttaacgacgatgagtgaactcagcactgaggaaatcaaagatttgcttcaaacagcacaagagctcaaaagcggaaaaacagacaatcagcttacaggaaagtttgccgcaaacctgtttttcgaaccgagcacgagaacgcggttcagctttgaggtcgcagaaaaaaagctgggcatgaatgtgctaaaccttgatggaacaagcacaagcgtgcaaaaaggcgaaaccttatatgacacgatccggacgctcgaatcaatcggtgtggacgtctgcgtcatcaggcacagtgaggatgagtattatgaagagcttgtcagccaggtgaacattccgattctgaatgcgggagacggatgcggccagcatccgacacaatcactgcttgatttaatgacgatttatgaagagttcaatacgttcaaagggcttaccgtctccattcacggtgacatcaagcatagcagagtggcaaggtcaaatgcggaagtgttgacaagattgggtgcccgggtcctattttccggcccttcggaatggcaggatgaagaaaatacattcggcacgtatgtctcaatggatgaagcagttgagtcttccgatgttgtcatgctgctgcgcattcaaaatgaacgacatcagtccgctgtcagccaggaaggctatttaaacaaatacggcttgaccgtagaacgggctgagcgtatgaagcagcatgcgatcatcatgcatcctgctccggtaaacagaggagtggagattgatgacagcttagtagaaagcgaaaaatcaagaatcttcaagcaaatgcaaaatggcgtatttatcagaatggcagtgatacagcgtgccttacaaaccaatgtgaaaagaggagaagcagcgtatgtcatatctcattaaaaacggctggatactaaacgaaaatggtgaaaaaacagaagcggatatccgagtgactggagaaaccatcaccgcaatcggcaagcttgatgcaacggataatgaaacggtaattgatgcaaaaggtttgctcgtttcacctgggtttgttgatctccacgtgcatttcagagagccgggcggagagaaaaaagaaactattgaaaccggggccaaagcggcggcacgcggcggctatactacagtagcagcaatgccgaatacgcggccggttcctgatacaaaggagcagatggaatgggtgcaaaacagaattaaagaaacatcatgcgtcagagttcttccatatgcatccattacgatcaggcaaatcggcgatgaaatgacaaactttgaagcgttaaaagaagccggggcatttgcttttacagatgacggtgttggtatacagacagcaggtatgatgtttgaagcgatgaaacgggcagctgcaattgacaaagcgattgttgcacattgcgaggacaactccttaatttacggaggaagcgtacatgaggggacattctccaaagcgaacgggctaaacggcattccttctgtgtgtgaatcggttcatattgcccgcgatgtgctgctggctgaggcggcaaactgccattatcatgtatgccatatcagcacgaaagaatctgtcagagttgtacgcgatgcgaaaaaagcgggaatcagagtgacagcagaagtgtcgccgcatcatttgctgctttgtgatgaggacatcccggggctggacacaaactataaaatgaatccgccgctccgcagtgcagaagacagagctgctttaattgaaggtcttttagacggaacaattgattttatcgcaacagaccatgcaccgcatacggaagaagagaaaaacacagaaatgaaactggcgccattcggaattgtcggcttagaaacagcattcccgcttctttacacacactttgtcaaaaatggcagctggtcgctgaagcagctgattgactacatgacaatcaagccatgcgaagcgttcggtctcccatatggaacattacaaacggggcaagctgcggatattacgttaatcgatttagaaaaagaagcagttatagacaaagagacatttttatcaaaaggaaaaaatacaccattcaacggcatcagctgcaccggctggccggtcgctacaattgcggcagggaagcttgcttatgaagaggggagacttgtcaaatgaagagacgattagtactggaaaacggagcggtattcgagggagaagctttcggaagcttagaacacaacatgggagaagtcgtttttaatactgggatgacaggctatcaggaaattttatctgatccttcttactgcggacaaatcgtaacattaacatacccgcttatcggaaattacggcattaaccgtgatgattttgaatccattaccccttttgtcaaagggctgatcatcaaagaattatgtgagctgccttccaactggcgttcagcatacaccttagacgagtatttaaaaatgaaaaacattcccggactccagggaattgatacaaggaagctgacaagaatgatccgtacggcaggcgcgctaaaaggaacattcgcttcatctgatgaagatatcgaagcagtgctgaaaagactgaacgaaacggaattgccaagaaatcaagtatcccaagtatcagcaaaaacagcatatccgagcccgggaagaggcaaacgcatcgtcttggttgacttcggcatgaaacacgggattctaagagagctgaacaaacggaaatgtgacgtcatcgttgtgccttacaacattacagcggaagaggtgcttcagctgaaaccggacggtatcatgctttctaacggacctggagacccgaaggatgtgcctgaagcgattgaaatgattaaaggtgttcttggaaaagtgccattattcggaatatgtcttggccaccaattattcgcgctggcgtgcggggcgaatactgaaaaaatgaaattcggccacaggggctcaaaccacccggtaaaagagctggctacaggaaaagttgccttaacatctcaaaaccatggatatacagtttcgtctatcagtaaaacagaactggaagtgacgcatatcgcaattaacgacgatacgattgaagggctgaagcataaaacattgccggcatttacggttcaatatcatcccgaagcctcacctggtcctgaggatgccaaccatctatttgacagattcatcgaaatgatcgaaacaacagagaaagaaggggaagcggtatgccaaaacgcgtagacattaacaaaattttagtaatcggatctggaccgatcatcatcggtcaagcagcagaatttgactatgcgggaacacaagcctgtcttgctttgaaagaagaaggctatgaagtcatccttgtcaactcaaaccctgccacgatcatgacagatacagaaatggctgaccgggtttatatcgaaccgctcacacctgaattcctgacacgaattatcagaaaagagcgcccggatgctattcttcctacactcggaggccaaaccggtttgaatcttgcggttgagctttctgaaagaggtgttctggcagaatgcggcgtcgaagtgcttggcacaaaactgtctgcgattcagcaagctgaagaccgtgacttgttcagaacattaatgaatgaactgaacgaaccggtgcctgaaagtgagattatccactcccttgaagaagcagaaaaattcgtcagtcaaattggattccctgtcattgtccgcccggcatatacattaggcggaacaggcggaggcatctgctcgaatgaaacagagctaaaagaaatcgttgagaacggcttgaaattaagcccggtacaccaatgtctgcttgaaaaaagcatcgccggctataaagaaatcgagtatgaagtcatgagagacagccaagatcacgccattgtcgtttgtaacatggaaaacattgatccggttggaatccatactggagacagtattgttgtcgcgccaagccaaacgctcagcgatcgcgaatatcagctcttgcggaatgtatcgttaaaactgattcgcgcgcttggaatcgaaggcggatgtaacgtccagcttgccttagatccagacagcttccaatattacattattgaagtaaatccgcgtgtcagccgttcatctgcccttgcatcaaaagcaacgggatacccgatagcaaagctcgctgctaaaattgcagtcggcctttcattagatgaaatgatgaacccggtaacaggaaaaacatatgcagcttttgaacctgctcttgactatgtcgtatccaaaattccgcgctggccgtttgataaatttgaatcagcaaacagaaagcttggcacgcaaatgaaagcgacaggtgaggtcatggcaatcggccgcacgcttgaagagtcattgctgaaggcagtgcgatcactggaagcggatgtgtatcatcttgaattgaaggacgccgctgacatttcaaatgagcttcttgaaaagcgaattaaaaaggccggtgatgaacgcttattctacttagctgaagcgtacagaagaggctacacggtagaagacctccatgaattttccgctatcgatgtcttcttcttgcataagctgttcggaatcgtacagtttgaaaaagaactgaaggcgaatgcgggcgatacagatgtgctgagacgggcaaaagaactcggcttctctgatcagtacatcagccgcgagtggaaaatgaaagaatccgagctttacagcttgagaaaacaagcggggattgctcctgtattcaaaatggtagatacatgtgcggcggaattcgagtcagaaacgccatacttctatagcacatacgaagaagaaaatgaatctgtcgttacagataagaaaagtgtgatggtgcttggttcgggtccgattcgaatcggtcagggtgtcgagttcgactatgcgacggttcactctgtatgggcaattaaacaagcaggctatgaagccattattgtcaacaacaacccggaaaccgtttcaacagacttcagcatctcagacaagctgtattttgaaccgcttacgattgaagatgttatgcacatcattgaccttgaacagccaatgggcgttgtcgtacagttcggcggacaaactgcgattaaccttgctgacgagctttctgcacgcggagtgaaaatccttggaacttcattagaagatttagaccgtgcagaagaccgggataaatttgaacaagcgcttggagaacttggtgttcctcagccgcttggcaaaacagcgacatcagttgatcaggcggtaagcatcgcgagtgatatcggttatccagtactggtgcgtccttcctatgtacttggcggccgggcgatggagattgtgtatcatgaagaagagctgcttcattacatgaaaaacgcagttaaaatcaatccacagcaccctgtattaattgacagatacttgacaggaaaagaaattgaagtcgatgcagtatccgacggtgaaacagtcgtcattccgggaattatggagcacattgaacgtgcgggcgttcactccggagactcgatcgctgtttatccgcctcagtctctcacagaggacattaagaaaaaaattgaacaatacacgatcgcattggctaaagggctgaatattgtcggtttgctcaatattcaattcgtcttgtcgcaaggcgaggtgtacgtgctagaagtgaatccgagatcaagcagaaccgtaccgtttttaagcaaaattacgggtatcccaatggcgaatctcgcaacaaaaatcattcttggtcaaaagctggctgcgtttggctatacagagggccttcagcctgaacagcaaggtgtatttgtaaaagcgccggttttctcctttgccaagctgagaagagtggacattacgttagggcctgaaatgaaatcaaccggtgaagtcatggggaaagattcgacacttgaaaaggcgctctacaaagccttgattgcttcaggtattcaaatcccgaactacggttccgtgcttttaacagtagctgataaggacaaagaagaagggcttgccattgctaagcggttccacgcgatcggctacaacattttagcgacggaaggaacggcaggctacttgaaagaagcttccattccagcgaaggtcgtcggaaaaatcggtcaggatggcccgaacttgcttgacgtcatcagaaacggagaagcgcagtttgtcatcaatacgctgacaaaaggaaagcagccggcaagagacggttttagaatcagacgtgaatcagtagaaaatggtgttgcctgcctaacatctttagatacggcagaggcgatattgcgagtgctggaaagcatgacattccgtgctgatcaaatgccggcagtcaacacaaatcaggaggcggcagtcactatatgaaaaaagcgtatttgacagtatgttctaaccagcaaattgcagaccgggtgtttcaaatggttctgaaaggggagcttgtccaagggtttacaacccctggacagttccttcatcttaaagtgagcgaagcggttacgcctcttttgagaaggccgatcagcatcgcagacgtcaactttgaaaaaaatgaagtcaccatcatttatcgggtagatggggaagggacaagactcttgtcactgaagcagcagggagaacttgtggatgtcctcgggcctttgggaaatggctttcctgttaatgaagttcaacccggaaagacggctttgctggtaggaggcggagtaggtgtgccgcctctccaagagctgtcgaaacgcttgattgaaaaaggggtaaatgtcatccacgttttaggattccaatcggcaaaggatgttttttacgaggaagaatgccggcagtacggagacacgtatgtggcaacagctgacggaagctacggggaaaccggatttgtcacagatgtgattaaacggaaaaatctagagtttgatatcctcctcagctgcgggccgacaccgatgctcaaggcgttaaaacaggaatatgcccataaagaagtatatctgtccatggaggaacgaatgggctgcggaatcggcgcatgcttcgcgtgtgtgtgccatacaaacgaaagtgagacgtcctatgtaaaagtatgtctcgacgggcctgtatttaaagctcaggaggtggcgctgtaatgctagaggtgaaattgccgggacttgatttgaaaaacccaatcattcctgcatcaggctgcttcggttttggaaaagaattttcacgtttttatgatttgtcttgtcttggagccatcatgattaaggctacgacaaaggagccacgctttgggaatccgacgccgcgggtagctgagactggtgctggaatgctcaatgcgatcggtctccaaaatccggggctggatagtgtgttgcataatgagctgccgtggcttgagcagtttgatacgccgatcattgccaatgtcgcaggttctcaagtcgaggattatgttgaagtcgcagagcatatcagcaaagcgcctaatgttcatgctcttgaattgaatatttcctgcccgaatgtgaaaacaggcggaatcgcttttggcacgaatcctgaaatggctgccgatttgacaaaagcggtgaaagaggtttcgaatgtacccgtttatgtgaagctttctccgaacgtggccaatatcacagaaattgccttagcgatcgaggaagcgggagcggacggtcttacgatgatcaacacactaatcggcatgagactcgatttaaaaaccggcaaaccgatattagcgaataaaacagggggactttcaggccctgctgtgaagccggttgccattcgcatggtgtatgaagtcagccagatggtcaacatcccgattattggaatgggaggcgtgcgaacggctgaagatgccctggaatttcttctcgcgggagcaagcgcagtcgctgtcggaacagcaaattttgtgaatccttttgcatgtccagagattattgaacagctcccatctgttttgcgccaatacggctatcaatcaattgaagaatgcatcggaaggagctggaatcatgaaaaacaacctgcccatcatcgcgcttgattttgcatcagctgaagaaacactcgcgttcttagctccttttcagcaagaaccgttatttgtaaaggttggaatggagcttttttatcaagaagggccatcgatcgtgaaacaattaaaagaaagaaactgcgagctgtttttagatctaaagcttcatgacatcccgactactgtaaacaaagcgatgaagcgccttgccagtctcggagtagatctcgtcaatgttcatgctgctgggggcaaaaaaatgatgcaggcagctctcgaaggcttagaagaaggtacgccggctggaaaaaaacgtccgtcactgatcgcggtaacccagctgacaagcacatctgaacaaatcatgaaagatgaactgctaatcgaaaaatctctgattgatacggttgtgcactacagcaaacaggcggaagagagcggactggatggagtggtctgctctgttcatgaagcaaaagccatttaccaagcggtgtcgccttcatttctgactgtcactccggggatcagaatgtctgaggacgctgcgaatgaccaagtccgcgtagcgacgcctgctattgcaagagagaaaggttcatcagcgattgtagtaggacgctcgattacaaaagcggaagacccggtaaaagcctataaggctgtcagacttgaatgggagggaatcaaatcttgaaacaaatcatcgcaaaacatctattagacatccaagctgtatttttacgcccgaacgagccgttcacatgggcaagcggcattttatcaccaatctactgtgacaaccgccttacgctatctttcccagaggtcagaaacgatgtcgcctcaggtatcagcaagcttgtcaaagagcattttcctgaagctgaaatgattgcgggaacagcaactgccggtattcctcatgctgctcttgcggctgaccgtttgaatcttccgatgtgttatgtgaggagcaagccgaagtcgcacggaaaaggcaatcagattgagggagctgtgcaagaagggcaaaaaacagtcgtcattgaagacttaatctccacaggaggcagcgtgcttgaagcttgtgcagctttacaagcggccggctgtgaggtgcttggtgtcgtctcaatctttacgtacggacttcctaaagcggaggaagccttcgcaaaggcagaactgccatactactcattaaccgattatgatacgctcacagaggtcgcgcttgaaaatggaaatattcattcagatgatctaaaaaagctgcaaacatggaaacgaaatcccgagtcgaaagattggtttaaaaaataaaaaataaattcaaatgatgtaaagaggcttcaaagccttgatgtacttgaaaacaggctgtgaggcctgtttttttattaatcctataaaaaaagtcgggttgacttatgttagaattgtgctaaaatttactacaaatctaaaaacttatcaagagcggctgagggactggacctatgaagcccggcaacctgcatagtttgtaaggtgctacttccagcaaaatgaattccattttgaaagataagggctacatgctgttcctgtctttctttccgccggattgaaagttttttattttaagaggtaaaaaggctatctgtatatcagcagccgcgaatcacattacatgggaaaagacaaccggcagaaagctactgtttgtttgtctccgaaaggaggaaagaagaaatgttaacgtatgataattgggaagaaccaacgattacatttccggaagacgatccttataaaggagcgctgtcagttttaaaatgggcatacggccattacggcaatcaacttgtttatgcctgcagtttcggaattgagggaatcgttctgattgacttaatttataaagtgaaaaaagacgcagagattgtgtttcttgatacaggacttcattttaaagaaacctatgaaacaattgaacgagtgaaagagcgttatccgggtcttaatatcatcctgaaaaaaccagacctcacccttgaggaacaagccgaagaacatggtgacaaactgtgggaaagagagccgaatcagtgctgctatcttagaaaggtcgttcctttaagagaggcgctttcaggacatccagcctggctttccggcctgcgtcgtgatcaagggccaagccgtgccaatacgaatttcttaaacaaagatgaaaaattcaagtcagtaaaagtttgcccgcttatccattggacttggaaagacatttggagatacacatcccggaatgaactggactacaatccgcttcatgaccaaggatatccaagtattggatgtgcgccttgcactgctcccgcttttacagcagaggatttgcgctcaggcagatggaatggtatggcgaaaacagaatgcggactgcatgaataaggagctgcaaaatggaattagccgctattttatttagcttgtttttcgcgatgaatattggtgcaagcggcgctgcagcttcgatgggggttgcttacggctccggagccatcaaaaagaaaacctacgctttgatcctatgcgcagtcggtgtctttgccggggcggtcattggcggaggcgaggttgtaaaaacaatcagctccggcattattcctgagcagacgattacactgacgattgtttgcatcattattggagctgctgccctgtcgctctttactgctaatctgctcggcattcctttgtcgacaagtgaagtaacagtcggcgcggttgtcggcgtgggagtggcttataaagtattgtttgtgaacaatcttctgatcattgtgtcattttgggtttttgtcccgctgttcgctttcggcttcacctatttcgtatctaagctgtttcgttattttaagattgaagtaaaatcttctaaaaagcaaaaaatcctcggcgttgttttgttagttgccggatttttcgaagcattctctgccggcatgaataacgtggcgaatgctgttggcccgttagtagctgccggtgtgcttgatgtcggaaaaggaaccttgtatggaggagcttttgttgctcttggcgcactgttattaggccggcgtgtgctagaaacaaacgggaagaaaattacgagattctccaaaggggaaggcattctcttatccggtacaggagccggactggtgatcatcagttctgtatttgggatgccggtgcccttggcgcaagtcacgtcatcgtctattatcggaataggcatggcaaaaaacggtccgaacgtgttccataaacaagttgttcaaacgatgctgaaggtatggatcgtatcgccgtttttatctttatcgatttcttatctgcttgtatccttgtttttaaaagcagattattattcgatctttatcatggtaagtgtgcttttagcggcgggcggtgccgtcagcctgacaaagaccattcgtaaagagagacgctcagtccacgaacaaggcgggggaatctgatcattaatctgagtaattttataagttaactaggaggagatggctattatgagcttagcaccacacggaggaacattagtaaacagagtagatgaatcatatgatgtgagcggcattcaaaaagaaattgaacttgatttaatttctttcgcggatttggaattgatcggtatcggtgcatacagcccgattgaaggtttctttaatgaaaaagattacgtatctgtagtcgaaaacatgcgtctttcttccggcgttgtctggtctcttccaatcacgcttccggtcgatgcgcaaaaagcagcggaactgtcacttggtgaaacggtaaagttaacgtatgaaggagaaacatacggcgttatccaaatcgaagacctgtacgtgcctgacaaacaaaaagaagctgtcaatgtgtacaaaacagatgaacaggagcatcctggtgttaaaaagctgttcagccgcggcaatacatatgtcggcgggccgattacgttgattaaaaaagcttcaaaacagttccctgaatttacatttgaaccgttagaaacgagacgccagtttgcggaaaaaggctgggaaaccattgtcggtttccaaacaagaaaccctgttcacagagcgcatgaatacattcaaaaaacggctcttgaaacagtagacggcttgttcttgaatccgttagtaggtgaaacaaaatctgatgacattccagctgatgtacggatggaaagctaccaagtgcttcttgatcattattacccgaaagatcgcgttttccttggtgtctttttagcggcgatgcgttatgcaggcccgagagaagcaattttccacgcgcttgtcagaaagaactacggctgcacacatttcatcgtcggccgtgatcatgcaggtgtaggcgactattacggaacatacgaagcacaggagctgtttgacacatttaaacctgaagaactcggaattacaccgctgaaatttgagcacagcttcttctgtaaaaaatgcggaaatatgggaacagcgaaaacttgccctcatggcagagagcatcacgtcattttatcaggcactaaggtaagaggtatgctgagagacggtgtgctgccgcctgctgaattcagtcgaaaagaagtcgtagaagtgttaatcaaagggatgaagaaaaaagaagaagtaggcgtatcttaaggaggactggcagtgacaaatcgcgatattgtatggcatgaagcctctatcacaaaagaagagtaccagcaaaaaaacaagcataaaagctccattctctggctgacagggttaagcggctcaggcaaatcaacgattgccaacgccgctgcgagagaattgtttgagcaaggctaccaagtgattgtgcttgacggggataatatccgtcacggcttaaataaggatcttggtttttctgatgaagaccgaaaagaaaacatccgccgaatcggagaggtggcaaagctttttgttcagcagggaaccattgtgattactgcttttatctctcctttccgcgaggacaggcaacaggttcgcgagcttgtggaagcgggcgaatttaatgaagtctacattaaatgcgaccttgatatttgtgaacaaagagatccgaaagggctttacaaaaaagcaagaaacggcgagattccgttctttacaggaattgattctccttatgaagaaccggaagctccagagctcgttcttgaatcaggacagcatgaccgtgaagcgtgtaaaaatcagctgatcgagtttgttaaacaaaaattgagctgaatatgatctgctgctttcttctcagatgccggaatgcaagcgagaacatcatcacagcgaatgctctggaagaactcgaatagatcgggggaaatacgatggggaaagtatatattgtaggagcgggtcccggtgaccctgatctgctgacaattaaagcgctgaaagccattgaaaaagctgatgtcatcttatatgacagattagtaaataaagagattttacaatatgccaaagagcaagcagacctgatctactgcgggaagcttccagattttcatacgatgaagcaagaaaccatcaatcggtttcttgtaaagtatgcgcaaaaagggaaaaccgttgtcaggctgaaaggcggagacccttttgtgttcggcagggggggagaagaagcggaatgtctctctgaaaacggaattccgtttgaaatcatccccggcattacgtctggaatcgcggcagccgcttatgccgggattcctgttactcatcgggaggcgggctctaacgtcgcttttgtaacgggtcattataaaaaagaagaagattttgaggaaaagtggaaagcgctggctacaggaattgatacacttgtcatctatatgggtatcaaaaacgtgcagcagattgaaagaaaactccttgaaaacggccgggacggttctacgccggcagcctttattcattggggaacaacggacaagcaaaaatctgttttttgtacagttgacaccctttcagaaacggtgataaaagaaaacattacaaatccgagtttaattgtcattggaaatgttgtaaattatcactataagctggaatggtttgaatctgaactgaaaaaacaagatttaagcgaggcgttgtaaaaatgaaacaagcaattttatatgtcggccacggcagccgggtcaaaaaagcacagcaagaagccgcagcctttttggaaggatgcaaggcccacatctctgtgccagtacaagaaatcagctttttagagcttcaggagcccacaattgagacaggatttgaagcatgtgtgaagcaaggcgccactcatatcgcagtggtgcctctgcttcttttaacagctgcgcatgcaaaacatgatattccggaagaaattgcccgtgttgcatcccgatatccgtcagtccgcatttcatacggaaagccgatcgggattgacgaagaagtagtcaaggctgtatatcaccgaatgaaagacataggtgttccatatgaaaatgccagagtggtactcatcggaaggggaagttcagatccagatgtcaaaagagacgtaaccggtattgctaatcttcttcaggaaataattccagtcaaggaagtcattccgtgctttttgacagcatgcggccctaattacaaagaggttttttcagaacttaaaaaagatgacggcataacaacctttatcgttccatatttgctttttacgggtatgctgatgaatgaaatcgaacgagaggttcagaaattaaaagcccataatccgaacgtctacctctcttcctatatcggttttcatcctcatgtgaaaaacgcatttttgaaccgtgtgagagaaactgcggcaaattctgagggacaatttgattttgatggaggttcatatgcttccgctgcacattagcctggaaaagaagaaggttgtgattgcggggggcggaagcatcgctctcagaaggctgaaaacggtgatttctgagggagctgatataacgcttgtcagtccggatgtggaaccggaaatcaagcaaatggcagaagagcggcgtatcaaatgggaaaaacggacaattgaaaaagaagattatctcaatgctttcttcattattgctgcgacggataatgcggcagtgaacaaagaaattgcccaatccgcttcgccttttcagcttgtcaattgtgtcagtgacgctgagcttggcaatgtatatatgccgaaaatcgtaaaaagagggcatgtcactgtgtctgtttctacaagcggagccagtccaaagcacacgaaagagcttgctgaaaacgtggataagctgattgacggcgattttattgctgaagtgaacaggctttatcaggtgagaaggaagaaataagccagagcatacaaatgctctggcttttctttatgcggctcagctttttttgagcttgatgacagtatcagcatcaggcgtgacaaagacggtatgctggctgtcataggtgactaaaccggttttcgcgccgtttggttttttgacatgcctgatttttgtataatctacaggcactgaacttgaatctttagcttttgaaaaataagctgcaattgtcgcggcttccatgattgtttgctcatccggttcgctgcttctgatcacaacgtgggagcctggaatgtccttcgtgtgaagccagatatcgtctctggccgccgctcttgtcgttaaatattcattttgacgattgttcttacccactaaaattgtcagccctgaggtggattcatatgtttctaacaccggattgtgcggtttttgctttttctggcctttttgctgcttagggcgtaaatatttgccctctacaagctcttccctgatttcgctgatatcccggggagaagcggacgaaagctgctgaatcagctgatcaaaatattcgatctcttcctgtgccagcctgatttgttcctcgacaaccgcgaccgaatttttcgctttctgatacttcgtgaaataggcctgtgcgttttcagaaggcgttttgttcgggtttaaaggaatcgtgattgtcgggctttcttcatcataatagttgatgacctcggcctgtttatcaccttttttcagcatatataaattagcggttaaaagctccccgtaaagctgaaattccttcgcgttttccgaatactccaaggttttctctaattttttaattttgttggcattcttcttccgttcgttcacaacaaaacgctcaagatcctgagcctgctgtttgacccggtctcgttcagcttttccgaaataaaaacggtcgagcagttcgcttaatgaatcaaaacggcgcgcttcgccctttagatgagtcagctccagcagataaaaatattcctttccgtttacagtcgtaatgttgggaatgaaacggtgctctttcacttcggcaaacaatgccagcaacgcttttggcagtgtgactttgttggcaaggcctgctctgtgaaccgcttctttggcgaaaagcggagacacgcctgaaaagtggtcgacaatttgtttatcaagccttccttcttgaaagctgaggtgacgcaaaatatcatcttctgacacctcaagaggcgatattttgtcctgagcaggcggaagcttataatcttggccgggcagtactgtacggtagctgttcattgacggtgataaatgcttaagtccgtcgataatcacattttctgctgcgtcagtcaaaatgatattgctgtggcggcccataatttctacataaagctttcgtacggtttcatcgccaatttcgtttcggcttttgatatgaaaaatcataatgcggtctaagtccgcttgttcaattttctcaatgaatccgccttcgatatgctttctcagcaacatgcaaaacattggcggttcgcttggattttcataagcttgtgccgtgatatgcacccgtgaatagctcggatgtgctgataataatagttttaggttttttcccttggcacgaatgtggaaaatcacatcgtgcttatatggctgatggatttttgtaattcgtccgcccattattttctcgttaagttcgtgagtcattccgtatgtaaacatgccatcaaacgacatatgcaatacaccctctcattcttcctgcattcgataattatagcatgaaatgggacgagtcagaataagcatgcttatagagtgatatctctataagagagcaggggagtggacgagcggaatgaagtttcatgaaatgggacaaacagatttactagaggcaaccaatacgtccatgaaacaaggattaacagaaaaagaggtaaaaaaacgccttgacaagcatggaccaaacgagctgcaagaagggaaaaaaacttcagcgcttctcttgtttttcgcgcagttcaaagattttatggtgcttgtgcttctggcggcaacgttaatctcaggatttcttggtgaatatgtagatgcggttgcgattattgcgattgtgtttgtgaatggcatactcggtttctttcaagaaaggcgtgctgagcaatctcttcaggctttaaaagagctttcaacaccgcacgtcatggcactcagggaaggaagctggacaaagattccttctaaggaactggtgccgggtgatattgtgaaatttacgagcggggacagaattggcgcagacgttcgaattgttgaagcgagaagccttgaaatagaagaatcagcgctgaccggggaatcaatcccggttgtgaagcatgctgataaattgaaaaaacctgatgtttcacttggcgatattaccaatatggcatttatgggaacgattgtgacccgcggcagcggtgtcggggttgtcgtcgggacaggaatgaatacggctatggggaaaattgccgacatgcttgaatcggcagggacattgtcaaccccgctgcaaagaagactagagcagctcgggaagattttgattgtggttgcattgcttctgaccgtacttgtcgttgctgtcggtgttattcaaggtcatgatctgtacagtatgtttttagcaggtgtctcgttagcggtagccgctattccggaggggctgccggcgattgtgacagtggcgctttcgcttggtgtacagaggatgattaaacaaaaatccattgttagaaagcttcctgctgttgaaacgcttgggtgtgcgtctatcatttgctcagataaaacagggacaatgacccaaaacaaaatgacagtgacgcatgtctggtccggagggaaaacatggagagtggcaggggccggctatgaaccgaaaggaagcttcacactaaacgaaaaagagatcagtgtcaatgaacataagccgcttcagcagatgcttctgttcggagcgctttgtaacaactccaatattgagaaaagagacggcgaatatgtgcttgacggagatccgacagagggagcgctgcttaccgcggcaagaaaaggcggtttttcaaaggagtttgttgaatcaaactaccgggtggtcgaagaatttccgtttgattctgcacggaaaatgatgactgtcatcgtagaggatcaagacagaaagcgctatatcattacaaaaggtgcaccggatgtactgatgcagcgatcttcccgtatttattatgatggctcagcggctcttttttcaaatgaaagaaaagcagaaacagaggcggtattaagacatttggcatcacaggcgctcagaacgatagcggtcgcctacaggccgataaaagcaggcgaaacaccgtcaatggagcaggcggaaaaagatctgaccatgcttggcctttcaggtatcattgaccccccgcggccggaagtcaggcaggcgataaaagaatgccgtgaagcaggaattaagactgttatgattacaggtgatcatgtagaaaccgctaaagcgatagcgaaagacttgcgcctccttccgaaaagcggcaaaatcatggacggcaagatgctgaatgaactttctcaagaagagctttctcatgtggtggaggatgtgtatgtatttgcccgcgtttcccctgaacataaactaaaaatcgtaaaagcctatcaggagaacgggcatattgtggcgatgacgggagacggcgtcaatgatgctcctgccattaaacaagctgatatcggcgtctctatgggcattaccgggacagatgtggccaaagaagcatcatctcttgttctcgtggatgataattttgcgacgattaaatcggcgataaaagaaggcaggaacatctacgaaaatatcaggaagtttatcagatacctgctggcgtctaacgtcggagaaatccttgtcatgctgtttgcgatgctgctcgcccttcctttaccgctcgttccgattcagattttgtgggtcaacttggtgacggacggattgccggcaatggcgctcggcatggatcagcccgaaggagacgtcatgaagcgcaagccccgtcatccgaaagaaggggtatttgcccgcaagctaggatggaaggtcgtttccagaggatttttaatcggagttgccactattttagcgtttatcattgtgtaccaccgcaatccggaaaacttagcttatgcccagacgatcgcgtttgccacattggtgctcgctcagcttattcacgtgtttgactgccgcagcgaaacttctgttttctctagaaatccgtttcaaaacctgtatttaatcggcgcggtattgtcatccattttgctgatgcttgtagtaatctactatccgccgcttcagccgattttccatactgtagccatcacgccgggggactggatgctcgtcatcggtatgtccgccatccctacttttttgctggcggggtcacttttaacaagaaaaaaataaattcatatgatataatcttaggggtaatagcgtgtctattgcccttttattatgagaacagggaagaattgggtgttttaaaatgatacgaagtatgacaggcttcggcagtgcaagcaaaacacaagacgatctctctgtaagcgttgaacttaaatctgtgaactacagatttaaagaagtgaacgctcgtttgccaaggcctttgctatattttgaagataagctgaaacagaccattctgcagcatattcagcgcggaagaattgagcttttcgtatctgttgacagcgatatgcttgttgagaaaaggcttgaaattgattggccgctgctcgatgagtttgtcgcagccgcgagagatatgaagaaacggtatcaattgtctgcagagcccgatgtaatggatttctttaagcttgatcatgtcgtccaggttcatgaagaacagacgcaaaatgacaagctggaggcgttgatcatcgatgctgcagaagaagcggtaaaaggtctctgtgaaatgcgtgaaaaagaggggctgctcttagcgaaagactgcctgatgcatattgatcagcttgaagagctggtgagagaaactgaattgctggctgcagatgtcgtatctcgttaccgggaacggctgtacgccagaatcaaagaatggactgaagacgtattagacgagagccggcttgtaacagaatgcgctatttttgcagaccgctctgatatcactgaagagattacaaggctgaagagccacttcgcccagtttcgtgatatattagctagtggcggagctgtcgggcgcaaactcgactttcttgttcaggagctcaatcgggaagcaaatacgatcggctcaaaagcaaatgatcatcagatcacaaagcttgtcgttgaaatgaaaagttctattgaaaaaataaaagaacaagtgcaaaatatagaatagtgactgtgcgtattgtttacagacggtcttactaggctaaactagagacgtctattttacagggggaacgtagaagatgacgattaaactgattaatatcggatttggcaatatcatctccgccaatcggatgatttcgattgtcagcccggagtctgcgccaatcaaacggatgattcaggatgcaagagaccgcggaatgctaattgacgctacatacggacgaagaacccgtgcagttgtcgtcatggatagtgatcacattatcttatctgccgtccagcctgagacagttgcacacagactttctgttaaagaagaaattatggatgaagggcaggggtaattgccgcatgaaagaaagagggttattaatcgttctctcaggtccctcaggagttggtaaaggaacggttcgacaagcgatcttttcgcaggaagacacaaaatttgaatattcgatttcagtaaccacaagaagtccaagagagggcgaagtgaacggagtcgattattttttcaaaacaagagacgaattcgagcaaatgattgcggacaacaagctgcttgaatgggcagagtatgtcggcaattattacggcacgccagtcgattatgttgaacagacgcttcaagatggaaaagacgtctttttagaaattgaagttcaaggggctcttcaagtgagaaatgctttcccggaaggcctatttattttccttgcgcctccaagcctttctgaactgaaaaacagaatcgtgacacgaggcacagaaacagacgctctgattgaaaatcgaatgaaagccgcaaaagctgagatcgaaatgatggatgcttatgactatgtcgttgaaaacgataatgtcgaaacggcttgcgataaaatcaaagcaatcgttcttgctgaacatttgaagcgtgaacgcgttgccccaagatataagaaaatgctggaggttgaataatcaatgttagatccgtcaattgattctttaatgaataaattagattcaaaatatacgctggtgactgtttctgcgagacgcgcacgtgaaatgcaaatcaaaaaagaccaaatgattgaacatacgatttcacacaaatatgtaggcaaagctttagaagaaattgatgcaggcctgctttcgtttgaaaaggaagaccgcgaatagtagcacaagtagcaacctatatcacatgtaggttgttatttttttccgtgcggttttgtaaagtgcagagggggagaattcattgctaaacaatcgaaatgtgttactttgcgtgagcggaggcatcgctgtttataaagcctgtgcgttaacgagcaagctggttcaggcaggagcaaatgtcaaagtgattatgactgaatccgcttgccgattcgtttcaccgctgacatttcaggcattgagccgccacgaagtctatacagatacatttaaagaacaaaatccaagcgtcatttctcatattgatgccgctgactgggccgacttgattatcgtagcgccggctacggctaatgtgattggaaaactggcaaacggcatcgctgatgatatgctgacgacaacattgttggcagcaacggctcccgtttggattgcgccggcgatgaacgttcatatgtatgaccacccggcagtcaaacgaaacatttctgttctttatcaggacggttatcgttttattgagccaagtgagggctatttagcatgcggttacgtaggaaaaggcagattggaagagccggaaaacatcgtaaagctggccgaaaaacattttgctgaagaaacatccgctcctttagaaggcaagcatgtggtcattacagccggtccaacgcgggaagcgattgatcctgtccggttttttaccaataaatcgacgggcaaaatgggctacgcactagcggaggctgctgttcagctcggcgcacgggtaaccttaatttctgggcctgtttcacttgatcagcctaaaggccttgctgagtttatccctgttcaatcggctgcggatatgcgcgaagctgtgctctctgtgtatgacgcaagcgatatagtcattaaaacagctgcggtagccgattttacgccgaaaacagtatttgaccataaaatgaaaaaacaagacggcggcatgaccttagaactgaaaagaacagtcgatattttgaaagaattgggcgagaaaaagaaagagcagattttggtcggatttgccgccgaaacacaagacattgaacactatgcacgtaaaaagctcgccgctaaaaaccttgatttgattgtggcaaatgatgtgaaagcaaatggggccggttttggtgctgatacgaatatcgtgacaatctttttcaaagacgggcataaacgcgaactcccgatcatgtctaagctcgatgtttcttttgaaatccttcaggagatcgcagccctctcaaaacaaaccggagagcgctcatgaattttgcagaagtcatcgttgatgtcagcaccaaaaatatagacaggccttttgattataaaatcccagaccatctgaagggcatgatcaaaacggggatgcgggtcattgttccgtttggcccccgtaagattcaagggtttgtgacagcagtcaaagaagcatctgacctatcgggaaaatctgtcaaggaagtagaggatttattagatcttacacctgttctgacagaggagcttatggatctgtcatcatggctgtcagacaaaacgctgtcttttaaaataacggcgcttcaagcaatgctgcctgccgccttaaaggcgaaatatgaaaaagaattaaaaattgcacacggcgccgatcttccgccgcaagtggaacggctgttttctgaaacaaagacgctgctgtattcagatatacccgatcatgatacgctgaaactgattcaaaggcatgttcaaaaaggggacattgacgtgacgtataaagtcgcgcaaaaaaccaataaaaaaatggtcaggcatattcaggcaaatgcgagtaaagaagagcttgctaagcaggctgagggattgtcccgccaagcagcaaaacaacaggcgattcttcactttctcatatctgagccggaaggtgtgaaaattcctgcggcggaattgtgcaaaaaaacggacacgagctctgcaaccatcaaaacccttatccaaaaagggcttttgaaggaaagctatgaagaggtttacagagatccctatcaggacaaaatgttcaaaaaaacagagcccctgccgctgacagacgaacagagggctgcctttgagcccatacgcgagacattggacagcgatgagcataaagtgttcctccttcacggcgtgacaggaagcggaaaaacggaaatttatctgcaatcaattgaaaaagtactggcgaaaggaaaagaagccatcgtcctcgtaccggaaatatcgctgacgccgcaaatggtcaaccgcttcaagggccgcttcggctcccaggtggcagtcatgcacagcggtttatccacaggagaaaaatatgacgagtggcgtaaaatccaccggaaggaagtacggcttgtcgtcggtgccagatccgccatttttgctccgtttgaaaatctcggaatgataatcatcgatgaagaacacgagtcttcctataaacaggaagaaatgccgcgctatcatgcgaaagaggtggcaatcaagcgggctgagcatcacagctgcccggttgtattagggagtgctacgccgacattagaatcatatgctagagcgcaaaagggcgtatacgagcttctttcactgaagcaccgtgttaaccaccgggtgatgcccgaggtttcgcttgtcgatatgagagaggagcttagaaacggcaatcgctcgatgttttcagttgaattgatggaaaagcttgaagaaacgattgccaagggtgagcaggcggtgctgtttttaaataagaggggctattcttcctttgtgatgtgcagggattgcggctatgtcccgcaatgcccgcactgcgacatttccatgacgtatcatcgttacggccaaaggctgaaatgccattattgcggacatgaagagcctgttccgcacacttgtcctgaatgcgcaagcgagcatatccgctttttcggaacgggaacacagcgagtggaggaagagctgacaaaagtgctgccaagtgcgagagtgattcggatggatgttgacacgacatcacggaaaggcgcccatgaaaaattactgtcagctttcggagaaggaaaagcggatattcttctcggaacgcaaatgatcgcgaaagggcttgattttccgaatgtcacgcttgtcggagtgttaagtgctgatacaacacttcatattcctgatttcagatcggctgaaaaaacatttcagctgttaacgcaagtcagcggccgggcaggcaggcatgaaaagcccggccatgtcatcattcaaacgtatacaccgtctcattacagtatccagctgacgaaaacacacgattatgaaacgttctatcagcatgaaatggcgcacaggagggagcaatcctatccgccatactactatttggctcttgtgactgtttctcatgaggaagtggcgaaagcagcggttacagctgaaaaaatcgctcattttttgaaagcaaactgcggagctgacacgaaaattctcggaccaagcgcgtcgccgatagccaggatcaaagatagatatcgctatcaatgcgtgataaaatacaaacaggaaacccagttatccgctttattgaagaagatactggaacattataaacgcgaaattgaacaaaaacatgtaatgatttcaattgatatgaatccttatatgatgatgtaagatctcacgtcttggagggtaacaaattggcagtaaaaaaggtcgtcacacatcctgcggaggttttggaaacacctgcggaaaccgtgactgtttttgataaaaagctaaaaaaactgcttgatgatatgtacgacaccatgcttgaaatggatggtgtcggactggcagcgccgcaaatcggcattttaaaaagagcggccgtcgtagatatcggggatgacagagggagaattgatctcgttaatcctgaaattttagaaaaaagcggcgagcaaaccggaattgaaggatgcttgagctttcctaacgtctatggtgatgtcacacgtgccgattatgtcaaagtgcgtgcgtttaaccgtcagggaaaaccgttcattctggaagcgcgaggctttttagcaagagccgtgcagcatgaaatggaccacttagacggtgtgctgtttacatctaaaataagtaaatactatacagaagatgaactagtggatatggaaggatgatttgatgacgagaatcgtatttatgggaacgccggatttttcagttcctgttttaagaaccctgatagaggacggatatgaagtagtgggggtcgtcacacagccggaccgtccgaagggcagaaaaaaagtactgacacctcctccggtaaaggaagaggcattgcgccacggcatcccggttcttcagccggaaaaagtcagattgacagaagaaattgaaaaagtgctggcattaaagcctgacctgattgtaacggcggcattcggacaaattttgcctaaagagcttctcgacagtccaaaatacggctgcattaacgttcacgcatcccttttgccggaactgcgcggcggtgctccgatccattattccattctgcagggaaagaagaaaaccgggattaccattatgtatatggtggaaaaattggatgcgggcgatatgatctcaaaagtggaagtggacattgaagaaaccgacaatgtcggaacactgcacgataaattaagcgttgctggcgcgaagctattgtctgaaacggttccaaacgtcattgccggaagcatatcacctgaaaagcaggatgaagagaaagcgacgtacgcgcctaacattaaaagagagcaagagctgctcgactggtccagaacgggcgaagagctttacaaccagatccgcggcttaaatccatggcctgttgcttatacgactctaaacggacaaaacttgaaaatatgggcgtcgaaaaaaatagcggcaccaacaacagctgagcccggcacagtcgttgcggttgaaaaggaaggaattatcgttgccacaggtaacgagacggctctgttattaaccgaactccagccggcaggcaaaaaacgaatgaaaggcgaagactttgtgcgaggcgctcatgttgaagccggtgatgtgttaggagtaaacaatgaaaaaaactagtgttcgtgacatcgcccttgaggcgctgatcaaattagaacaaaaccaggcatacagcaacctgctgctgaaatcggtcattaaatcaaatgaactgagtgatcaggacagagggcttttgactgaacttgtctatggtacattacaaaataagatcgcgcttgattatatgcttaaaccgtttatcaataagcctcaaaaggtaaagccgtgggtgattcagcttcttcgcctatccttatatcaaatggagtatttggagaagattccagacagggcagccattcatgaagcggttgagattgctaaaatccgcggacacaaaggcattgcttcatttgtcaacggcgtgctccgttctattcagcgcgaaggtgttccatcctttgacgcgatcgaagatcctgtccgccggctggcgacagaaacaagccatccggaatggcttgtgaaagagtgggcggatgcgtatggatttgaagctgcggaaaagatttgccgcatccatctcattccgccgaaacagacgctgcgtgtcaatcaaatgaaagcagacagagctgagctgcttgaccaaatggctgctgagggaatcgaagttgaaaaaggcgacctcgctgaagatgctgtgaagctcttaaagggaacaattgccggaactcatttcttccaaaacggcgaagtttctatccaggatgagagctccatgctcgtcgcccgcgcccttgatcctaagtcagatgaaacagtgcttgacgcgtgtgcggcgcctggcggaaagtcggctcatatcgcagaattaatgaagaacaaggggagcgttacgtcgcttgatcttcacaaacataaagtgaagctgatcaaagaagcggcagatcggcttggcctgacaatcattcatgcggaaacaatggatgctagaaaagcgggggaaacgtttgaaaacgaacagtttgaccgaatattggtcgatgccccgtgctcaggtttcggtgttatcagaagaaagccggacatgaaatacacgaaaaaacctgacgacagcgcccgtctagctgaaatccagctgtcgatcttgagggaaatcgcaccattagtaaaaaaaggtggcactcttgtctacagtacgtgtacaatggaccggacagaaaatgatgaagtaatacatgcgtttatacaagaacatcctgattttgaacccgatttgtctcttgaaaagcggctgcctgaaaaggtgagaccctttgttcgggatggaaggcttcaaatccttcctcattatttcggaacagatggtttctttatttgcagcatgagaaagaagggataagcaatggcagaacttaataaaacaaaagtaagaaaagaattgcggacagagcgtccgtctatttattcttttgaattagatgaaatcaaacaatggctgacagacaatggagagaaaccgttccgtgcagcccagatctttgaatggctatatgaaaaacgcgtatcttcttttgaagatatgacaaacctctcaaaggatctgcgtgagaaattaaacactcactttgtgttaacaacgctgaaaacggctgttaaacaaacctctcaagacggtacgatgaagtttttgtttgagcttcatgacggttataccatcgaaaccgttttaatgagacacgagtatggcaattctgtatgtgtaacgacacaagtcggctgccgtattggctgcacattctgcgcgtcaacgcttggaggcttaaaacgaaaccttgaagcaggggaaattgtcgctcaagtagtcaaagtgcaaaaagctcttgatgaaacggatgaacgcgtcagctctgtcgtgatcatgggaatcggcgaaccttttgataactttaacgaaatgctcgctttcttgaaaatcattaaccatgacaagggcctgaatatcggtgctcgccatattacggtctctacgagtgggatcatcccgaaaatttacgaatttgctgatcagcaaatgcagattaactttgcaatttctctgcacgcgccgaacacagaaatcagaagccgtttgatgccgattaacagagcatataaactgcctgatctaatggaagccgttaaatattatattaataaaacgggacgccgcatcagctttgaatacgggctgttcggaggcgtaaacgaccaggtggaacacgccgaagagcttgccgacttgctggaaggagtcaaatgccacgtgaacttgattccggtaaactacgtgcctgaacgggactatgtgcgcacaccgcgtgatcagatttttgcttttgaaaaaacgctgaaatcccgcggagtaaatgtcacaatccgaagagagcaaggacatgacattgacgcagcctgcggtcagcttcgcgcgaaggagcgtcaagacgagacgaggtgatgagggttgttaacagccttaaaaacagatacaggaaaaatccgccagcataatgaagatgatgcggggatattcaaggggaaagatgaatttatattagcggttgtcgctgatggcatgggcggccatcttgctggagatgttgcgagcaagatggctgtgaaagccatgggggagaaatggaatgaagcagagacgattccaactgcgccctcggaatgtgaaaaatggctcattgaacagattctttcggtaaacagcaaaatatacgatcatgctcaagcccacgaagaatgccaaggcatggggacgacgattgtatgtgcactttttacggggaaaacggtttctgttgcccatatcggagacagcagatgctatttgcttcaggacgatgatttcgttcaagtgacagaagaccattcgcttgtaaatgaactggttcgcactggagagatctccagagaagacgctgaacatcatccgcgaaaaaatgtgttgacgaaggcgcttggaacagaccagtcagtcagtattgacacccgttcctttgatatagaacccggagacaaactgcttctatgttctgacggactgacgaataaagtggaaggcactgagttaaaagacatcctgcaaagcgattcagctcctcaggaaaaagtaaacctgcttgtggacaaagccaatcagaacggcggagaagacaacatcacagcagttttgcttgagcttgctttacaagttgaagagggtgaagatcagtgctaatcggcaagcggatcagcgggcgttaccaaattctccgcgttataggcggcgggggaatggccaacgtgtatttagctgaggatatcattctagaccgtgaagtcgcaattaaaatcctgcggtttgactatgcaaatgacaatgaatttatcagacgtttccgcagagaagcccaatccgcatcaagcctcgatcacccgaatattgtcagcatttacgatttgggcgaggaagatgatatttattatattgtcatggaatacgttgaaggcatgacgcttaaagaatacataacagcaaatgggccgcttcaccctaaagaagcgctgaacatcatggagcaaatagtctcagccatcgctcatgcccatcaaaaccagattgttcacagagacatcaagccgcataacattttgattgatcatatgggaaatatcaaagtaacggattttggaattgcgacggcactaagttcgaccacaatcacccataccaattcagttctgggctcggtccattacttatcacctgaacaggcccggggcggcttagccacaaagaaatcggatatttatgcgcttggaatcgttctatttgagcttttaaccggccgtattccgtttgatggagagtcagcagtcagcatcgccttgaagcatcttcaagcggaaactccttcggcaaaaaggtggaatccatcggtcccccaaagcgttgaaaacatcatactcaaggcaactgccaaagatccttttcatcgctacgaaacggctgaagacatggaagcagacataaaaacagcttttgatgccgacagactcaatgaaaagagatttacgattcaagaagatgaagaaatgacaaaagcgatacctatcattaaagatgaagaactcgctaaagctgctggcgaaaaagaagctgaagtgacaaccgcacaagaaaacaaaacaaagaagaacggtaaaagaaaaaagtggccgtgggttttgctcacgatatgcctcgtttttatcacagctggaattcttgctgtcactgtttttccgtcgcttttcatgcctaaggatgtcaaaatacctgatgtctccggaatggaatacgaaaaagccgcagggctcttggaaaaagaaggtttacaggttgattccgagttgttggaaatctcagatgaaaaaattgaagagggcctgatggtaaaaacggatcctaaagcggataccacagtcaaagaaggcgccacggtcaccctttataagagcaccggaaaagcaaaaacggagatcggtgatgtgacaggccaaacggtcgaccaggcaaaaaaagcgttgaaggaccaagggtttaaacatgtaacagtaaatgaagtgaatgacgagaaaaatgcgggcactgtcattgaccaaaatccttcagcagggactgagcttgtcccgagtgaagatcaagtcaaacttacagtcagtatcggacccgaagacattacgcttagagacttgaaaacctatagtaaagaagcagcgtctggatatctggaagacaacggattgaagcttgtagaaaaagaagcatactcagatgatgttccagaaggacaggttgtcaaacaaaaaccagcagcaggtacggcagtaaagccgggaaacgaagttgaagtgacattctctctcggaccagagaaaaaacctgcgaaaacagtgaaagaaaaggtcaagatcccctacgaaccagaaaatgaaggggacgagcttcaagtgcaaatcgcggttgacgatgcggatcacagcatctctgacacttacgaagaatttaagataaaagagccgactgaacgaacgatcgaactaaagattgaacccggccaaaaagggtactatcaagtaatggtaaacaataaagttgtcagctacaaaaccattgagtatccgaaagatgaataacaaggagggaaaatatgcctgagggcaaaattattaaggcgctaagcggcttttactatgtactggatgaatcagaggattcagataaagtaatacaatgcagaggaagaggcattttcagaaaaaacaaaattacccctcttgtcggtgattatgttgtgtatcaagctgaaaatgacaaagaaggatatttaatggaaattaaagaaagaaccaacgagcttatcaggccgccaatttgcaacgttgatcaagcggtccttgttttctcagcggttcagccttctttcagcacggcattgctcgaccgcttcctggttctcgttgaggccaatgatattcagccgattatatgcattactaaaatggatctgattgaagatcaagatacagaagatacgatacaagcctatgcagaagactatcggaatattggttatgacgtataccttacctcctctaaggaccaagacagtttaacggacatcatcccgcattttcaggataaaacaacggtatttgccggtcagtccggtgttggaaaatcctcgcttctcaacgcgatcagtccggagctcggattgagaacaaacgagatttccgagcatttgggccgcgggaaacacacaacccgccacgtggagctgattcacacgtccggaggtttggttgcagatacgccgggattcagctcgcttgaatttacagacattgaggaagaagagctgggctataccttcccagatatcagagaaaaaagcgcttcatgcaaatttagaggctgtttacatctgaaagagccgaaatgcgcggtgaaacaagctgttggagacggggaattaaagcagtatcgctatgaccattatgttgaatttatgacggagattaaagacagaaagccgaggtattagcataatgataaaggttgcaccatctattctttccgctgattttgccgctttaggcaatgagattaaagatgtagaaaaaggcggagccgattgtattcatattgatgttatggacggccattttgtcccgaatatcacaatcggtccgctgattgtagaagccgtccggccggtaacggatctgccgcttgatgtccatttaatgatagaagagccggatcgttatatcccggcttttgcgaaagcaggcgcagatatcctgtctgtgcatgctgaggcatgtccgcacctgcaccgtaccatccagctcattaaagagcaaggagtgaaggccggagtggttctaaacccgcatacccctgtacaagtcatcgagcatgttttcgacgatctcgatcttgttcttttaatgacggtgaacccgggcttcggcgggcagaaatttattcattcagtccttcctaaaataaaagaggttaagcgaatggcggatgaaaaaggaaaaaaagatctgttaattgaagtagacggcggcgtcaacaaagaaaccgctccgctcgtcattgaagcgggcgcaaatttactcgttgccggttcagctgtttatggccagtctgaccgcaaaaaagcaatttctgaaatcagaggaagtaaataagcagctttagaaaagagctgggcatacaatagcctaagctctttttcctgtatgcagagaaaggaatcagagatgaaaacaattaatatcgttgcgggaggcccgaaaaatctcattcccgatctaaccggctatacggacgaacacacgctttggatcggtgttgacaaaggcaccgtcactctcttagatgccgggatcattcctgttgaagccttcggagattttgacagcataacggagcaagaacgccggcgaatagaaaaagccgctcccgcccttcatgtgtatcaagcagaaaaagatcaaacagatttagacctcgcccttgattgggcgctggaaaagcagccggatattattcagattttcggcattacaggcggcagagctgatcattttttaggaaacattcagctactgtatagaggtgtaaaaacgaacataaaaattaggctgatagacaaacaaaatcatattcaaatgtttcctcctggtgaatatgatattgagaaggatgaaaataagcgatatatctccttcataccgttttccgaagacatacatgagctgaccctgaccggttttaaatatcctctaaataattgtcatattacgctcggttcaacactatgtattagtaacgaactcattcattcacgaggtactttttcgtttgcaaaaggcatattaataatgataagaagcacggattaagcatgtgctttcattcaattgctgaaaacaatgaacaaggcggttacgggacgttataggaggggacaaaaatgaaattttacaccattaaattgccgaagtttttaggaggaattgtccgggcgatgctgggctcatttagaaaagattaatgcccaggggttcaaagccctctttcaccacataaaaacgcctgccacatatcggggcaggcgttcattttgttatacacgctcaactttaccggatttcaaagctcgagcagatacatatacttttttaggttttccgttcacaaggatacgaaccttttgaagattcgcgccccaagtgcgcttagaagcgttcattgcgtgagaacggttattcccagctgttgtttttttacctgtgataacgcatttacgtgccatttgtttccctcctcacttgcacaaaacatctactttttaacattcatataatcttagatgctttcgatatggatactttaaataatttaccacagctaaaaaacgtttgcaactattgtttcatcatctttcaagaaaattcacttgacatcttgcggaaacagcagcgctatagtatatgtagaggtacggccagcgattattgcctggtcttttcataatggaaaccatatagtagaatagctgtaactctatgcattcgaaggaggaactagtgtgtccattgaattaagaacgaagtacggacagattgatatatctaatgaagtcatcgcgatggttgcaggaggcgcggcggttgactgttacggcattgtcggcatggcctctaaaaaccagattaaagacggactgactgaaatccttcggaaagagaatttcagcaggggtgtccaagttcgccaagaaggagaacagatacatatcgacatgtatatcattgtcagctacggcacgaaaatttctgaagtggcacataatgtccaaacaaaagtaaagtacacagtaaatcaaaccatcggactggcagtggactctgtcaatatttatgtccaaggcgtacgagtgacgaacccgtagttaggaggagtaggattgtctatcagaacattaaacggcagaacctttgccgagatgattcttgcgggagcgcagaatctgtctcaaaatgccagtgcagttgatgcactgaacgtgtttccggtgccggacggtgatacgggaacaaatatgaacctgtcgatgacttccggagcaagagaagttgaacaaatggatacggatgatatcgggaaggtgggttccgcgttatctaaagggctgctcatgggagcacgcggaaattcaggagtgatcctatcccaattgttccgcggatttagcaaaagcattgaaacgaaaaaagaaattaatgcacttgagtttgccgctgcgctgcaagcaggtgtagacatggcgtataaagctgtcatgaaacctgtagagggcaccattttaacagttgcaaaagacgctgcaaaaaaagcgatgatcttagcagaaaaagaaaccgatatcactgcgctgatgattgcagtgacagaagaagcagaggcgtctttaaaccgcacccctgaattgctacctgtcctaaaggaagtaggagttgtcgatagcgggggcaaaggcctgctctgtgtgtatgaaggtttccttgcttcattaaaaggtgaaactgtacctcagaaagcagttcttccgtcacttgacgacatggtcagcgcagagcatcacaagagcgcgcaaagcatgatgaataccgaagatattgaatttggattctgtaccgaagtgatggttaggcttgatcagacaaaaagagagttcgacgaaggcacgttcaggcaagacctcagccagttcggagattctctgcttgtgattgcggatgaatcgctggcgaaggttcatattcatgctgaagagccgggaaacgtgttaaactacgcccagcattacggtgaattgatcaaaataaaaatagaaaatatgagagaacagcatacctctatcatcagtcaagaaagcaaacctgcagacaacgaaacaccgccggcaaaacagccgtatggcattgtgactgtggcgatgggagaaggaatttcagacctattcaaaagcattggcgcttctgttgtgattgaaggcggccagaccatgaacccaagcactgaggatattgttgatgccgtgaagtctgtaaatgcagatacggtatttatcctgcctaacaactccaacattatcatggctgctaaccaagcggccagcgtagtggatgaacaggtttttgtcattcctgctaaaacggttccgcaagggatgtcagctctgctggcttttaacccggatcaagaagctgaagcgaacgaggccaatatgctaagcgccattcagcaagtaaaaagcggacaggtgacgttctcagtcagagatactcatattgacggtaaagacattaaaaaaggcgactttatgggcattctgaatggaacgattatcggcacttctgaaaatcagctgtcagccgcgaaattgctgctgtcagaaatgatcggagaagatgatgaaatcgtgaccattctatatggtgaggatgcgtctcaggaagaagctgagcagcttgaagcgtttctcagtgaaaagtacgaggagattgaggttgagatccacaatgggaaacagcctctgtattcgtatatagtttcagcagaatagaagggcaatttgcccttctattcttatgtctgcttttaagtgcggcagcgctgtaacgcgcccgcttgccattttatatctgatcaattagtctagaagcaaagcgctaataagctctggttcataaggaggaatagcatgaaatacagaagcgtttttgatattatcggcccggttatgatcggtccgtccagctctcatacagcgggagctgctagaatcgggagagtggccagaagtttatttggcagagagcctgagcgcatcattgtatctttttacggctcgtttgcggaaacgtataagggccacggcacagatgtcgcgattatcggcggattgcttgattttgatacattcgatgaacggattaaaaccgctatacaaattgcagaagctaaaggaattgatatagagtttcgggtagaagacgcagtcccggtccatccgaacacagcaaaaatcaccatttctgatgaaaagggtgagctggaactgacgggtatttcgattggcggaggaaagattgaaatcacagaattgaatggttttgagctccggctgtcaggaaatcatccggccatattagttgttcataatgacaagtttggcacaattgccggtgttgccaatgttctggcgaaattttcaatcaacgtaggacatatggaagtagcccggaaagatatcggccagcttgcgctgatgacaatagaggtcgaccaaaatattgacgaccacattctcgacgagctgtcgaaactgccgaatattattcaagtgacaaagattgctgactagcgaaaagggtcaggaggagccagttatgtttcgtaatgtaaaagaattaattgagattactaaagaaaaacaaatattgatctctgatgtgatgatagctcaagagatggaagtaacagaaaaaacaaaagaggacatttttcagcagatggatcataacctgtctgttatggaagcggcggttcagaaaggactcgagggagttacgagccaaacgggcttaacaggcggagatgccgttaaattgcaggcctatattcgatcaggaaaaagcctgtctggcccgctgattttagatgctgtatcgaaagccgttgcaacaaatgaagtaaatgcagcaatgggaaccatctgtgcgacaccgactgcaggttctgccggtgtggtgcccggtacgttatttgctgtaaaagaaaagctgaatccaacaagagaacaaatgatccgctttttgtttacggccggggctttcggatttgtcgtggctaataacgcaagcatttccggcgccgccggaggatgtcaggcagaggttggatcagcttcaggcatggcggctgcggccattgttgaaatggcaggaggaacacccgaacaaagcgcggaagccatggccattacattaaaaaatatgctaggcctcgtgtgcgaccctgttgcagggcttgttgaggtgccttgcgtgaaacggaatgcgatgggcgcgtcaaatgcaatgattgccgctgatatggcattggcgggcattacaagccgtattccatgtgatgaggttatcgatgccatgtataaaataggccaaacgatgccaactgcacttagagaaacaggccagggcggtttagcggcaacaccgacaggaagagaattagagaaaaaaattttcggaggagcgctaggttcacgtgaaacaacatcagcaaactagtatagctaacattaagggtattgggccggaaacagaaaaaacattacacgaactcggtatttatgacatttctgatcttctgaattatttcccttatcgctatgatgactacgagctgagggatttagaagaagtaaagcatgatgaaagagtcacagttgaagggaaggttcattcagagccttctcttacctattacggaaaaaaacgaaacaggctgacattcaggcttctggtcggccactatttaattacagccgtatgttttaaccggccttatttgaagaagcagctttcgctcggctctgtggtgacggtttcaggtaaatgggacaagcaccgccaaaccatctctgttcaggagttgaaaaacgggccgcatcaagaagacaaaagcattgaaccagtgtattctgtgaaagaaaatgttaccgtcaaaatgatgaggcggtttattcagcaggcgctgacccaatatgcagactcacttcctgatcctcttccggaaaagctaagaaaaagctataaactgcctgactattatcaagcgttaaaagcaatgcaccagcctgaaacaagggaagcattaaagcttgccagacggcggtttgtttatgaagaatttttgttgtttcagttgaaaatgcaggcgttccgaaaggcggaaagagagcagacacaagggatacggcagcgtttttcaaacgaagaactcatgagatttatcaaaagcctcccgtttcccctcacaaacgcccagtcacgcgttcttcgcgaaataacagcagacatgtcttctccatacagaatgaaccgtcttcttcaaggggacgttggatcaggaaaaacggcagtcgccgccattgcactgtatgccgcgatcctatccggataccaaggagcgctcatggtgccgacagaaattctggccgagcagcatgctgattcgctcgtttcgctatttgaaaaatgggacgtcagcgttgctcttttgacaagctctgttaaagggaagcggcgaaaagaactgcttgagcgtcttgcggcgggtgagattgatattcttgtaggaacccacgctttaatccaagacgaggtggagtttaaggcgctgagtctcgttattactgatgaacagcacagatttggagttgagcagcgcaaaaagcttcggaacaaagggcaggatcccgatgttctctttatgacagccactccaatcccaagaacgttagcgatcacagtgttcggtgaaatggatgtatctgtcatcgatgagatgccggctggacgaaagagaatcgaaacctattgggtaaaacatgacatgctggatcgtatattggcatttgtcgaaaaagaattaaagcaaggcaggcaggcttatatcatctgtccgctgattgaagaatcagacaagcttgatgtgcaaaacgccattgacgtgtacaatatgctttctgatatttttcggggaaaatggaatgtcggccttatgcatggaaagctgcattccgatgaaaaagaccaggtcatgagagaattcagcgcaaatcactgtcaaattctcgtatcaaccactgttgtggaggttggcgtgaatgttccgaatgcaacaattatggtgatttatgacgccgaccgtttcggactatcacagcttcaccagctgcgcggccgtgttggacggggtgagcatcaatctttctgtattctgatggctgatccaaaatcagaaacagggaaagaacggatgaggatcatgtcggagaccaatgacggtttcgagctgtctgaaaaggatctggaactgagaggtcccggtgatttcttcgggaaaaaacaaagcggaatgccggaatttaaagtggcggacatggttcatgattacagagcgcttgaaacggcaaggcaggatgctgcgaatcttgtggcttctgacgcgttctggaaggagccggaatacgctgtgttaagagatgaattgctgaagagcggagtaatggacggggaaaaattaagctgagtatcagaagtttttggtgttcagccagaaacaatcgttgcattccaatctatgaaattatatactactattagtacctagtcttaattgtccggatggtgtttagatatgagaagaaataagagagaacgccaggaattacttcagcagacgattcaagcaaccccctttattacagatgaagaattagcgggtaaattcggggtgagcatccagacgatacgtttggaccgcttagagctttccatacctgaactgagagaaagaattaagaacgtggcagagaaaacacttgaggacgaagtgaagtctctgtcacttgatgaagttatcggagaaattattgaccttgagctggatgatcaggcgatatccattttagaaataaaacaggagcacgtgttcagccggaatcagattgcgagaggacaccatttatttgcacaggcgaattctttggcagttgcagtcattgatgacgagctggcgctgactgcaagtgcagacatccgctttacaagacaggtaaagcagggtgaacgtgtcgtagcaaaagcgaaagtgacggctgtcgaaaaagaaaaaggaagaacggttgtcgaagtgaacagctacgttggcgaagaaattgttttttctggacgctttgacatgtatcgttcaaaacattcataaaggtggagcatgcatgagaatagctgtagatgcaatgggaggagaccacgctcccaaagctgttattgacggagttataaaaggtatagaggcatttgatgatctccatatcacacttgtcggtgacaaaacaacgatagaatcacatttaacaactacatcagatcgcatcacggtgctgcacgcagatgaagtgattgagcctacggatgaacctgtccgtgccgtgcgaagaaaaaagaactcatctatggttcttatggcgcaggaggttgcggaaaacagagctgacgcctgcatttcagcaggaaataccggtgcattaatgacagccggtctctttattgtcggaagaattaaaggaattgaccgtccggcgcttgccccgacacttccgactgtttcgggagacggatttcttctccttgatgtcggcgccaatgtcgatgccaaaccggagcacctcgttcaatatgccatcatgggttctgtttattctcagcaagtgcgcggtgtcacttcaccgagagtcggacttttaaatgtcggaacagaagataaaaaaggaaacgaactgacgaagcagacgtttcaaattttaaaagaaacagcaaacatcaattttatcggaaacgtggaagcgcgagaccttttagatgatgtggcggacgttgtagtaacagacggctttaccgggaatgttacactcaaaacgctggaaggctctgcgttgtctatttttaaaatgatgagagacgtaatgacgtctactttgacatccaagcttgcagcagctgtgctgaagccaaaattgaaagaaatgaaaatgaaaatggagtattcgaattatggcggagcaagtctttttggcttaaaagcgcctgtgatcaaggcgcacggctcttcagattcaaatgctgtattccatgcgattcggcaagcaagagagatggtcagccaaaatgtggctgcgctcattcaggaagaagtgaaagaagaaaaaacagatgagtagtctggaggtttttacatcatgagtaagattgcatttttattcccgggtcagggatcacaatttatcggcatgggaaaagagctttatgaacaggtgcctgctgcaaagcgtctgtttgatgaagccgatgaaacgttggaaacaaaactcagctcgcttatttttgagggggatgctgaagaattaacacttacatacaatgcgcagcctgctttgcttacgacaagcatcgctgttcttgagaaatttaaagaatctggcattacacctgatttcacagcaggacacagccttggtgaatattctgcactggttgcggctggcgctctgtctttcaaagatgctgtttataccgtcagaaagcgcggagagtttatgaatgaagcggtgccggctggcgaaggagcaatggctgcgattctcggcatggatgctgaagcattaaagcgagtaaccgataaagtcacagaggaaggcaaccttgtacagcttgcgaatctcaactgtcctggccaaatcgtcatttccggaacagctaaaggggttgagcttgcatctgaactggcaaaagagaacggcgcaaaacgcgcaattccgcttgaagtaagcggtccgttccattctgaactgatgaaaccggctgctgaaaagctgaaagaggtattggacgcctgtgacataaaagacgctgacgttccggtcatctcaaatgtttctgctgacgtgatgactgaaaaagcagatgtcaaagaaaaacttattgagcagctttactctccggttcgttttgaggaaagcattaacaagctgatcgcagagggtgttacgacttttattgaaatcggtcccggaaaagtgctttcaggccttgtgaaaaaagtaaatagacggttaaaaacaattgctgtatcagatccggaaacgatcgagctggcaattcaaacgcttaaggaggagaatgataatgcttaatgataaaacggctattgtcactggcgcatcccgcggaatcggccgctcaatcgcccttgatctggcaaaaagcggcgtcaatgttgtcgtgaactactccggcaatgaagcgaaagcaaatgaagtggttgatgaaatcaaatctatgggcagaaacgcaattgctgtcaaagcggatgtatcaaatcccgaagatgtacaaaacatgataaaagaaacgctatcagttttttctacgattgacattctggttaataatgccgggattacaagagacaatctcatcatgagaatgaaagaagacgaatgggatgacgttattaacattaacctgaagggtgttttcaactgcacgaaagctgttacaagacaaatgatgaaacagcgttcaggccgcattattaacgtatcgtctatcgtcggcgtcagcggaaaccctggacaagccaactatgtggctgcaaaagccggcgtcatcggtttaaccaagtcttctgctaaagagctcgccagccgaaatattacggtaaacgcaatagcgccaggatttatctcaactgatatgacagataaacttgcaaaagacgttcaagacgaaatgctgaaacaaattccgctcgcgcgctttggtgaacctagcgatgtcagcagtgttgtcacgttcctagcttcagagggagcccgttatatgacaggccaaacgcttcatattgacggcggaatggtgatgtaagttttttctcgaaaatttcatcatagtttctctagttttttaaaaacgaatccactataatacttgaggggaggtgaattgctatggcagacacattagagcgtgtaacgaaaatcatcgtagatcgccttggcgttgatgaagcagacgtcaaacttgaagcttctttcaaggaagacttaggtgctgattccctagatgtagttgagcttgttatggaacttgaagacgagtttgatatggagatttctgacgaagatgctgaaaagattgcaacagtcggcgacgctgtgaactacatacaaaaccagcaataagctgatgctaaaagtcccgccgaaacgcggggctttagccctttattcgtgcagttattacagcatgccgcttttacgcgcgctgtatccggtttagtcagagaagcgcggtgaacctgatgtgcctatggaggttactatgtcaaaacactcacattataaagataaaaaaaagttctataaaaaagtagaacaatttaaagagtttcaagaacggatttcggttcactttcaaaatgaaaagcttttgtatcaagcatttacacattcatcttatgtgaatgagcatcggaaaaagccgtatgaagataatgaaaggcttgaatttttaggtgacgctgttttggaactgacgatctccagattcttatttgccaaatacccggctatgagtgaaggagatttgacgaaattgagagccgcaattgtttgcgaaccgtctctcgtttcattggctcacgagctgtcattcggcgatcttgtcctgttgggtaaaggcgaggaaatgacaggcggaagaaagcgtcctgctctattggcggatgtttttgaggcatttatcggagccttgtatcttgaccaaggattagagccggtcgaaagtttcttaaaagtttatgtgttccctaaaattaacgatggtgctttttctcatgtgatggatttcaaaagccagctgcaggaatacgtgcagcgggacggcaaaggctctctggagtataaaatctccaacgaaaaaggacctgcgcacaaccgtgaatttgaagccatcgtatctctaaaaggtgaaccactcggagtcggaaacggccgttcaaagaaagaagccgaacagcacgctgctcaggaagctttagctaaattgcaaaaacaccatacgaaacaataaaatcccccttatgactcagggggatttcagtatgtatgccgtcttatttcaccaatgtttatgatagaattgaaatacttattacataaggaggatcgctatgttcctcaaacgtttagacgttataggatttaaatcatttgcagaacggatttccgtagacttcgttaaaggcgtgacagcggttgtcgggccgaacggaagcggaaaaagcaacatcacggatgccattcgctgggttctcggcgaacaatcggcacgctctcttcgcggcggaaaaatggaggacattatttttgccgggagtgattcaagaaagcgattaaatctagctgaagttacgcttactcttgataatgatgatcatttcttgccaattgacttccacgaggtgagtgtcacaagacgtgtgtacagatcaggtgagagtgagtttctgattaacaatcagccgtgccgcttgaaggatattattgatttatttatggattctggccttggtaaagaagcattttctattatcagccaagggaaagtggaagagatcctgagcagcaaagcggaggatcgccgcagtatctttgaagaagcggccggggtgcttaaatataaaacgagaaagaaaaaagcagaaaataaactgtttgagacacaggacaatctaaatcgggtagaagatatattacatgagcttgaaggacaggttgaacctctaaaaattcaagcttcattagcgaaagactaccttgagaaaaagaaagagctggagcatgttgaaattgcgctgactgcctatgatatcgaagagctgcatggtaaatggtcgactcttaaagagaaagtgcagatggcaaaagaagaagagcttgctgaatcgtctgctatttctgcgaaagaagcaaagattgaggatacaagggacaaaatacaagcgcttgatgagtcagtagatgagctccagcaagttttactggtaactagtgaggagctggaaaagcttgaaggccgtaaagaagtcctgaaagaacgaaagaaaaacgctgtgcaaaaccaagaacagcttgaagaagccatcgttcagtttcagcaaaaagaaacggttctgaaagaagagctttcgaagcaggaagctgtcttcgaaacgcttcaggctgaggtgaagcagttaagggcgcaagtaaaagaaaaacagcaggctctcagtcttcacaatgaaaatgtcgaagagaaaatcgagcagctgaaaagtgattattttgagctgttaaacagccaggcttcgatacgcaacgaactccagcttcttgatgaccagatgtcccaatccgctgtcacattgcagagactcgcggacaacaatgaaaagcacctgcaggaacggcgtgatatttctgcgcgtaaagccgcatgtgaaacggaatttgcccgaattgagcaggagattcacagtcaagtcggtgcatatcgtgatatgcagacaaaatatgagcagaaaaagcgtcaatacgaaaaaaatgaatccgctctgtatcaggcataccaatacgttcagcaagcgagatcaaaaaaggacatgcttgagacgatgcagggagatttttctggcttttatcaaggtgttaaagaagtgctaaaagcgaaagagcgccttggtggaattcgcggagcggttcttgagctgatttctacagaacagaagtatgaaacggccattgaaatagcgctcggcgcttctgctcagcatgtcgtgaccgacgatgaacaatctgcccgaaaagcgattcaatatttaaagcagaattccttcggccgggcgacgtttctgcctctttctgttattagagaccgccagcttcaaagccgtgacgcggaaacagccgcccgacattcatcatttctcggggttgccagtgaacttgtcacatttgattctgcgtatcgaagcgtcatccagaatcttcttggaaccgttctgatcacagaggacttaaagggtgcaaacgagcttgcgaagcttctcgggcaccggtaccgcatcgtaacccttgagggagatgttgtgaaccccggtggttcaatgacgggcggcgcggttaaaaagaaaaataactccctccttggaagaagccgggagctagaagatgtgacgaaacggctcgctgaaatggaagagaaaacagcactgcttgaacaagaggtcaaaacccttaagcaatccattcaggatatggagaaaaaactggctgacttaagagaaaccggggaaggcttaaggttaaagcagcaggatgtgaaaggccagctgtacgaacttcaagttgccgagaaaaatatcaatacccatttagagctctatgaccaagaaaaatctgctctgtctgaaagcgatgaagagaaaaaagcgcgcaaacgcaagcttgaagaagagctctctgccgtatctgaaaagatgaaacagcttgaagaggacatagacagactgacaaaacaaaaacaaacgcaatcctcaacgaaagagtctctctccaacgagctgactgagctgaagatcgctgcggccaaaaaagagcaggcttgcaagggggaagaggacaaccttgccagattaaagaaagagctcactgaaacagagcttgcgttaaaagaagcaaaagaagacttaagcttcttaacgtcagagatgtcatctagcaccagcggcgaagaaaagctggaagaagcagcaaaacataaattgaatgacaaaacgaaaacgatcgaactgattgcattaaggcgcgatcagcgcatcaagcttcagcatgggcttgatacgtatgagcgtgagctgaaagaaatgaaacgtctgtataaacaaaaaacaacgctcttaaaagacgaagaagtcaaactcggacggatggaagtcgagcttgataatttactccaatacttacgggaggaatacagcttgtcctttgagggggcaaaagagaaatatcagcttgaaactgatccagaggaagccagaaagcgcgtgaagctgattaaactcgcaattgaagagctgggtaccgtgaacctcggaagcatagatgagtttgagagggtcaacgaacggtacaagtttctgtcggaacaaaaagaagatttaacagaagcgaaaaataccttgttccaagtgattgaagaaatggatgaagaaatgacgaagcgctttaacgacacattcgtccaaatccgctcacactttgatcaagttttccgctccttattcggaggagggcgagctgaactgaggctcaccgatcctaacgatctgcttcattcaggagtcgagattatcgctcagccgccggggaaaaagctgcaaaacttaaacctcctgtcaggcggagagcgtgcgcttactgctatagcgctcttattctcaatcctaaaggttcgtccagtgccgttttgcgtccttgacgaagtagaggctgcgctcgacgaagcgaatgtgttccgatttgcgcagtatttaaaaaaatacagcagtgatacccagtttattgtgattacccacagaaaaggaacgatggaggaagcggatgtgctttatggcgtaaccatgcaggaatccggtgtttccaaggtaatctccgttaagctggaagaaacaaaagaattcgttcagtaacgaggaaagaggttaaaagatgagcttttttaaaaaattaaaagagaaaatcacaaaacagacagattccgtatctgaaaagtttaaggatggccttgaaaaaacaagaaactcctttcaaaacaaagtgaatgatcttgtatcccgttaccgtaaagtggatgaggatttcttcgaagagcttgaagaggttcttatcagcgcggatgtcggttttacaaccgttatggaattaatagatgaactgaaaaaagaagtcaaacgcagaaatattcaagatccaaaggaagtccagtcagtgatttctgagaaactggtcgagatttataacagcggagatgagcaaatttcagaactgaacatccaggatgggcgtttaaacgtaatccttctggtaggtgtaaacggcgtcgggaaaacaacaacgatcggaaagcttgcccataaaatgaaacaagaaggaaaatctgtcgtacttgccgccggagacactttcagagcgggagccattgaacaactggaagtatggggagagcgtacaggagtgcctgtcattaagcagacggctggaagcgatccggcggctgtcatctacgatgctgttcatgctgcgaaagcaagaaatgccgatgtattaatttgtgatacggcaggtcgtctccaaaacaaagtaaatctcatgaaagagcttgaaaaagtaaaacgtgttatcgaaagagaagttcctgaagctccgcatgaggtgctgcttgcccttgatgccacgaccggccaaaatgcaatggctcaggcaaaagagttctctaaagcaacaaatgttaccggcattgctttaacgaagcttgacggtacggcaaagggcggtatcgtccttgcgattcgcaacgagcttcacatcccggttaaactagtcggtttaggagaaaaagttgatgatcttcaggaatttgatccagaatcctatgtgtacggactcttttcagatttagtggaaaaagccgacgattaagaaaatggccccaacatcttggggccttttcttttttatcttcttacttgataggcgaaatgataaaggctgttatcagtggataccagtcttgactcaccagaaaaaactctgaatgggatgatgtcatagtaatgaacggaaacagatgtgtaatacgtatagtaaccagcagctggccccaaatacattggaacctcaaatgttccgtttgcatcagttgttcctgaagcagtttgtgttgtgtttccgaccttcgtgtccgcttcaaatcttacgggcgcgtttggcactggctgtccgttttggtcgagtaatttgccgcttactgtaatattgtacttgactcgccaatattgaccttgtccgtaattgattttaccgtaaacccctccatctgtgctgatatttgtgatcgaagccttataaggtgcctcagcagcgtctgcttgctgtgccggaaaacctattgtaaacagggctgccagacataacataaacaataaaccgatttttttcataaaaatcctcctttaaatagggttcatatacaatatcggaataaattggatgatatttagcgtattttggaaaaagttaatcaccgctttgacaagataaaaacttgacagtgtcaataaaaccgtgtaaactaagttatcgtaaagggatttgacttaacaaaggggagagctcaaatgtcactcgaaaagacaacgagaatgaattatctgtttgatttttatcagtcgttgttgacgtcaaaacagaagagctatatgtcgctttattatttggacgatttctccctaggcgaaatagccgaagaatatgaggtttcaagacaagctgtttatgataacatcaaacgaacagaagcaatgcttgaacaatatgaagaaaagctgctccttttgaaaaagtttcaggagcgtaaagagatgtttaataagctgaaggagcttgcttccggttcaaaagaagaggaagaaattacagctctgattgaagcgcttgagaaattagattaggaggcggcaaactatggcatttgaaggattagccgaccgactgcagcagacgatttctaaaatccgcggaaaagggaaagtcagcgaacaagatgtaaaagatatgatgcgtgaggttcgccttgcgctgcttgaggctgacgttaactttaaagtagtcaaagattttgtcaaaaaagtaagtgaacgcgctgtaggccaagacgtcatgaaaagtctgacgcccggccagcaggtcattaaagttgttcaagaggaactgactgagctgatgggcggcgaagagagcaaaatcgccgtcgcaaaaaggccgccgactgttattatgatggtcggtctccaaggtgccggtaaaacgacaacaagcggtaagcttgcgaatctgctgcgcaaaaagcataatcgcaaaccgatgctggttgctgccgatatttaccgcccagccgcaattaagcagctggaaacactcggcaaacagcttgatatgcctgttttctctcttggcgatcaggtcagtcctgtagaaatagctaaacaggctattgagaaagccaaggaagaacattatgactacgtcattttggatacggcagggcgcttgcatatcgaccatgaactgatggatgaactgaccaacgtcaaagaaatcgcgaatccggaagaaattttcctggttgtcgattcaatgaccggtcaggacgctgtgaatgttgccaaaagctttaatgaacagctcggtttaaccggtgttgtgttaactaagctggatggagacacacgcggcggggctgcgctttctattcgcgctgttacaaacacgccaattaagttcgcaggtttgggcgaaaagcttgatgcgttagagccgttccatcctgaacgcatggcatcaaggattctcggcatgggcgacgtgctgacattgattgaaaaagcacaggccagcgttgatgaagacaaagccaaagagctggaacaaaaaatgagaacgatgagcttcacattggacgattttctggagcagctcgggcaagtcagaaacatggggccgcttgatgagcttctgcaaatgatgccgggtgcaggtaaaatgaaaggcctgaaaaacatccaagttgatgaaaaacagctgaatcatgtggaagcaatcattaaatcaatgactgttcttgaaaaagaacagccggatatcatcaatgccagccggcggaaacggattgcaaaaggaagcgggacatccgtacaggaagtcaaccgtctgcttaagcagtttgatgaaatgaaaaaaatgatgaagcagatgacaaacatgtcaaaaggcaagaaaaaagggtttaagctaccttttatgtaatcggttatacatgataaaaccgttgttaagaaaaaacactttacaaacacttttatcattgttaatatactatcttgttgaaatattttcggaggtgctagtaaaatggcagtaaaaattcgtttaaaacgtatgggagcaaaaaaatctcctttctatcgtattgttgtagcagattctcgttcaccacgtgacggccgtttcatcgaaacagtcggaacttacaacccggttgcaaaaccagcggaagtaaaaattgacgaagagcttgctcttaaatggcttcaaactggagcgaaaccatctgatacagttcgcaacttgttctctagccaaggaatcatggaaaaattccacaacgctaaacaaggcaagtaatgactgatcaacacttggaagatttgattgtccacattgtgacgccgcttgttgatcatccagatgacattcgcgtcataagagaagaaaccgatcaaaagattgcgctgcgcttatctgtccataagtcagataccggtaaagttatcggaaagcaaggccggactgcaaaagcgattcgaacagctgtatttgcagctggcgcacagtcttctaagaaagttcaatttgaaatatttgactaaaagggagagggccggcacctcccctttttttacacgcaaaaaaagggtaaactgatagaagcttaggcaaaatagaaaagcctgggcgagtaaaagttttaaaagcggggagcttggtgcgatgcaaattattcaccgtgtagccgttatgcaagtcttaaccgagcgcagcaaagaaaagcttttagcttcttttgccgaaaagaaacaaatgcttgaacgagaatgcagccagctctattttcagcttagaaaacatgagaaagaacagcaaaaccctgatatgattgaacaatttaaaaaggcaatagaaaagcgaaaagatgatataaaaatcatcgattttcaaattgctcaagtacatacattgccgcttggcagtgagttgaaagaaaaggaagtcgatgcgctgctgacgattgaagccggggatgactggcatgagaaaacagcagcgaacaccatcgtcataaaagacggaaaagtaattgaaattcgccagaggtgatcatatgacaaagcgatggtttaatgtaggcaaaatcgtaaatacccacggaatcaaaggcgaagtgcgggtgatttcaaaaacagattttgccgaagaacgatacaagccgggaaacacgctgtatttgtttatggacggccgtaacgaaccagtggaggtaacggtaaacacacatagactgcataagcaatttcatctcctgcagtttaaagaaagacaaaacctaaatgaagtagaagagctgaaaaacgcaatcattaaagttcctgaagaagaattaggagagctgaatgagggtgaattttatttccacgaaattattgggtgtgaagtatttactgaagaaggcgaactcatcggaaaggtcaaagaaattttgacgcctggagccaatgacgtttgggtcatcggaagaaaaggaaaaaaagacgcactcattccttacattgaatcagtggtcaaacatatcgatgtcagggaaaagaaaattgagattgaactgatggaagggttaatagacgaatgaaaatcgactttttgacgctgtttcccgaaatgtttgaaggcgtgctcggctcatcgattcttcaaaaagcccaggaaaaagatgcggtgcagtttcaagtcgtaaatttccgggagtactctgataacaagcacaatactgttgatgattatccttatggcggaggggcaggcatggttctcaagccccagcctgtttttgacgcggtcgaggacctgacatcaaaggcagccgctgctccgcgtattatcctcgtatgcccgcaaggtgagcgttttacccaaaaaaaagccgagcaattagctaaggaagagcatttgctgttcatttgcggccactatgaaggctatgatgaacgcattcgcgagcacttggtaacggatgaaatatcaattggcgactttgttctgacgggcggtgagctccctgcaatgatgatcgcagacagtgtggtcagactgcttccgggtgtactgggtaaagaggcttcccatattgaggattccttcagcaccggacttttagagcacccgcattatacaagaccggcagattacaaaggtttaaaagtgcctgaaacactcttgtcaggaaaccatgcaaaaattgaagaatggcggaataaagaatcgatcagaaggacctacctaagacgtccggatctgttgaaagactacccgcttacagagcagcaaagaaagtggatttctgaatgggaaaaagaatagattttattgcataggctatgaaattgtgataagatactacttgtggcttaagcgggcttatccgctgcaagcttgaaaacgatgttccgctgtgccggtttttgtggccaagagcatctgttggaaggagttgaaaacgatgcaaaaactaattgaagatatcacaaaagaacagcttcgtactgatcttcctgcgttccgtcctggtgacactttacgtgtacacgttaaagttgttgagggtaaccgtgagcgtatccagatctttgaaggtgttgtgattaagcgtcgtggtggtggaatcagcgaaacgttcacagttcgtaagatttcttacggtgttggcgttgaacgtactttcccagtacacacaccaaaaatcgcgaaaatcgaagttgtacgttacggtaaagtacgccgtgctaaactttactacctgcgtgaacttcgcggaaaagcggctcgtattaaagagatcagacgataatgataacgaacgaaaagagcttgttacctgtaacaagctctttttttatacagaatttgaaaatgccggacaggcatcgtaaaatacataaaggacaacaatgaatcatgcatactgaagataaaggcggtgttcgtgtcacatgacaattcaatggttcccgggccatatggcaaaagcaagaagggaagtaaccgaaaaattaaaattaatcgatatcgtatatgaattggtagatgccagaattccaatgtcatcaagaaacccaatgattgaagatattctaaaaaacaagccgcgaattatgctgttaaacaaggctgacaaagcagatgcggcagttacacagcagtggaaagagcactttgagaaccaggggatccgctctctgtctattaattctgtaaatggacaagggttaaatcaaattgtgcctgcatcaaaagagattctccaagaaaaatttgaccggatgcgtgcgaaaggtgtgaaaccgagagcgattcgcgctttgattatcggcattccaaacgtcggaaaatcaacgctcatcaaccggcttgcaaagaaaaacatagcaaaaacgggagacagacctggcattacgacttctcaacagtgggtcaaagttgggaaagaattagagctattagatacaccggggattttgtggcctaaatttgaggatgagcttgtcggtttgagacttgcagtcactggggctattaaagactcgattatcaatttgcaggacgtggccgtgtttggtcttcgttttctcgaagaacattacccagaacggcttaaagagcgttatggccttgaggagatcccagaggacattgctgagctgtttgatgcaataggtgaaaagcggggctgtctcatgagcggtgggctcattaactacgataagacgactgaagtcatcattcgcgatattcgcactgaaaagttcggcaggctgtcatttgaacagccgacgatgtaaaggcgcgcagaaatgcgggtctttattttttcttggctgaaccgatacatatagtaagggagaagagaaagtgaatacattaaccgtaaaggacattaaagaccgtttgcaggaagtgaaggatgcacaagacccatttattgcccaatgcgaaaacgacccgagaaaaagcgttcaaacgcttgtagagcaatggcttaaaaagcaagcgaaagaaaaagcgctgaaagaacaatgggtgaatatgacttcctatgaaaggctggcaagaaacaaaggatttcgcttgattgcaggtgttgacgaggtcggccgggggccattggcaggaccagttgtcgccagcgcagtcatccttccagaggaatgtgaaatacttgggctgacagactccaaaaagctttcagagaaaaaacgcgaggaatattacgagcttattatgaaggaagcactggcggtcgggataggaattgtagaagctactgtgattgatgagatcaatatatatgaagcttcaaaaatggcaatggtgagagcgatacaggatttgtcggatacacctgattatttgcttgttgacgcaatgacacttccgctcgacacggctcaggcgtcaattataaaaggcgatgccaaaagcgtgtctattgcggcaggtgcgtgtatcgcaaaagtgacgagggaccgaatgatgagcgcttatgccgaaacgtatcccatgtacggctttgaaaaaaataaaggctatgggacaaaagaacatttggaagctctcgctgcatacggcccaactgaattgcaccgcaaaactttcgctcctgttcaatctttcagataaatcaccatggacaaggaggcacctttttaaaatgaacatacgaaatgatgtgcaaaaggcgctgcagcagcttttcgggcgtacagccgtcccgcaggaaacatcaaaagtaaacgaagcgctaaacggggagaagcgtctcctcttaggaaaagtgcttcgtttactaggagatcagcatgccctgatccaagtcggcaatcaaactgttcagggaaaacttgaaactcagcttcgtcctcaggcatactattggttttcctacgaaaaaaaaacggcagagcaaacaggccgtcttcaggtcgttcaaagctttgatcaaaatcctaaaaccattcaggatgcagctggcaaacttttaaatgctatttcagtgaagacgtcaaacgcagctctcatgatgacaggagcgatgctgaaaagcaaaacacccgtaacagaaaatgatatcaaaacagctgtccgctggatggacacgctgccttcgcaagacacaaaaaaagcagttgaaacggttctcttcgctttaaagcgtgatcttcccattcactccgagattttgaatggtgttcacgctgtgaaatcgcctgttccgttgcatcagcacgtatcccagctgctacaggcaatcgaccaaaaccctcagcagagccaaatgatgtcaaagctaaaggaagcagttaaggtgcttttaaatagtgaaatcgatgtccatgcagaacggctgattgataagcttatttctttaaccgacaatacgaaagcaccttctccgacgaatacagctggaagtagggagcttagcacaccagctggctcccccggaaaagccagcctgccgattgcaaatcacacagcagaacagggaagcatacaagaagagcctgttaaaacagcagcagacattccaattaaagaagcccgccagctgctcgtgaagctgacggaatctgctgaaaaaaacagtctccaaattgtgaaagaagcagcaaattggattaaagcggctgcttcatcgggtgatagtaagtcacttgcagcttcagctgttttacaagcggcacaagtcacagaccaggaagccgaagtctttttaaaggctgttcagcagacagcaccccatttggcggataaggcagatgttctttctttcttatccaaagtgaaaacggcaatcggcgcaagggacgaggttgggttcattaaagcgtttgaacaaggaagcgcagtcacatctggcgaaatgcaatccatcaagctggctctttctgccttaagagcatcgcatgaggtagccgaaccagtcaaacaagaagccgatcagctttttcataaattaaatggccagcttttcatgcagcaggaccatccatcatacagccaaattgtaatgtcatttccgatgttttcgaagtcaggggttcaggacatgactgttctgtttaaaggaaagaaagaagcggatggaaagcttgatccttcccattgccgccttttgtttttgctgcagcttgatacactaaaagaaaccgtcgttgattgcttggtacaacaaaaagtcatgaccattacaatagagactgatttcgagctgcaggctgcgatcgatccgatggtgcccgcgcttaaacaggggctaaaggaaatggggtacagcctttcaggggtaaacgctaaaaaaagggttcacaccgaagaaaaggcttcaatcgatcaatatataacaagtatcagtgatcaggaagtggatgtgaaaatatgaaagagcagacaccgatcagaaaagctgttgctctccattatgacgaacaaaaagacaaggcgccgagagtgattgccacagggaagggccatgtagctgacaacattatcaaagaagcgaaaaaagcaggggtcccgattcaagaagatcggacccttgtcgaattaatgcgccatttgacggtagatgatcaaattcctgaagctctttatgaaacggtagccgagattttttcattcatttacaaattggacgaaagcgtaaaaaacaaaaaatagctaaaatattccccatcctcctttgaaatttatgtttttaataaagtaaaagtttgaatgtttagaaggattaaaagattttgcatcgaactgtagacaattcttccagtattattatagaatgaaagcgcagtctattttagttttgttacataagttaggaggatgggaaatgaatatccatgagtaccagggaaaagaagtcctcagaaaatatggggtatctgttcctgaaggtaaagtggcttttacagcagaagaagcagttgagagtgcaaagagcttatccagctcggtttatgtcgtaaaggctcaaattcatgctggcggtcgaggcaaagctggtggggtaaaaatagcaaaatcattagacgaagtaaaagcgtatgccgaagaactattagggaagaccctagttacacatcagacgggtccggacggccaagtaataaaacgcttacttattgaagaaggctgcgatattaaaaaagaatattacatcggtctagtgcttgaccgcgccacttcaagaatcgttttgatggcttctgaagaaggcggaacggaaattgaagaggttgcggagaaaacaccggaaaaaatcaaaaaagctgtcattgatccggctgttggccttcaaggctatcaagccagagaaattgcattcgctattaatattccaaaagagctcgtgggaaaagctgctaaatttatgcttggactatataaagcgtttgttgagaaagactgctcaatcgccgaaatcaatccgcttgttgttaccggcgacggaaatgtgatggcgcttgatgcaaaattgaattttgacagcaatgcgttgtaccgacaaaaggacattatggaatacagagatttggatgaagaagatccgaaagaaattgaagcgtccaaatatgatctaagctacatttcccttgatggaaatatcggctgtatggtaaacggcgcggggcttgcgatgtccacgatggatattatcaagcattatggaggagaaccggccaacttccttgatgtgggcggcggtgcaaccgctgaaaaagtcacggaagcatttaaaatcattctttctgatcaaaacgttaaagggatttttgtcaacattttcggcggcattatgaaatgtgatgtcatcgcagaaggggttgttgaagcgactagacaagttggtttgacattgccgcttgtcgtccgtcttgaaggcacaaacgtggatctagggaagaaaatccttagtgaatcaggattaaacattacatctgcggaatcaatggctgacggcgcgcagaaaatcgtatccttagtttaagaaagaatgaaaggcaggggaccaaataatgagtgttttcattaataaagatacaagagttattgtgcaagggattacaggttctaccgctttatttcatacgaagcagatgcttgagtacggcacaaatatcgttggcggtgtaacacctggaaaaggcggaacagaagcggaaggtgttcctgtatttaatacagtggctgaagcagttcaaacgaccggcgctaacgcgtctgttatatatgtgcccgcaccgtttgcagctgatgcgattatggaagcggtagatgcggagcttgatctcgtgatttgtatcacagaacatatcccggttttggatatggtgaaggtcaaacgcttcatggaaggcaagaaaacgagactgatagggccgaactgtcctggtgtcattacgcctgaagaatgtaaaatcggcattatgcccggatacatccataaaaagggtcatgtaggcgttgtatcacgttcaggaacattaacatacgaagcggtgcaccagctctcagaagcgggtgtagggcaatctacagctgttggaatcggcggcgaccctgtaaatggaacaaactttattgacgttttaaaagcgtttaacgaagatcctgacacacacgcagtcatcatgattggcgaaatcggcggtacggccgaagaggaagcggcagagtgggtaaaagccaacatgacaaaaccggtagtcggttttatcggcggtaaaacagcacctcctgggaagcgcatggggcatgcaggcgccattatttccggcgggaaagggacagctgatgaaaaaatcaaaacccttaatgcatgcggaatcgaagttgcagagacaccttctgtcatgggtgaaaccttaatcaaggtgctgaaagagaagaacttgttcgaaacttgtaaaacgcattaataaaaaagggacagccgtcaaggctgttcctgctttttctaacaaaaggaggtcaatctattggatcaggccgctgcctgcctaacgatttgcagaatcaatcaattattatccccatcccttctattaaaatggtggaaagccgatccgtctatgtcgctgacatcacccgtgttacaaacggttactcgtgatcaaataaaagcagctgcattaaaaaacgaaatagaacaattttatccaaagctcccgcgtgtacttgctgcttatcgtgagcaaggcattaacaccatccctatttcttcaaagcaatatcctttctggcttaaaagcatttatgatccccccgccgtactgtttgcaaaaggtgatatgactcttctttcgaaagggagaaaaattggaattgtagggacaagaaatccaacagcttatgggaaacaagttgtcaatcatcttacaaaagagatctgtcgtaaaggttgggtgattgtcagcggactggcgtctgggatagacggaatgtcccatgctgcaagtattaaggcgaaggggcggacaattggcgtcattgcaggcggatttcaacacatttatccccgagaaaaccttcagttagcagatcacatggctaaacaccatatcctgctgtcagagcacccacctgaaactaaaccccaaaaatggcatttccctatgagaaaccgtattatcagcggactaagtgaaggcgttattgtcgttcagggcaaagaaaaaagcggttcgctgattactgcctatcaagcattggaacaagggagagaggtatttgccgtacccggttcattgtttgacccttacgccggaggtcctataaaactgatccagcagggggctaaagccatatggtcagcagaggatattttcgaggaacttcctgagagaaacgttcaatatacggaacccttttgaattatcgtttgacaaacggtattgtaatatttaataatagtgaggatttaaagttgcatattgttttctatttaattaatgacgttcatgataaagaatgaaatgttgaaagccaaataaagacagctgcaaaaataaaattgaaatatcttgaaaagagagagaacacctcttgagggggatgaaaatgtctgattatctagtcatcgtggaatcgcccgctaaggcgaaaacgattgaacgttacttaggtaaaaaatataaagtaaaagcatcaatgggacatgtccgggatcttccaaaaagtcaaatgggagttgacatagaacagaattttgaaccgaaatatattaccattcgaggtaaaggcccggtattaaaagagctgaaaacggctgcgaaaaaagccaaaaaagtgtatctcgcagccgaccccgacagagaaggggaagcgattgcatggcatttggcacacagtcttgatttagatctcaactcagactgccgtgtggtgtttaacgaaattacaaaagacgctattaaggaatcgtttaagcatccccgcatgatcaatatggatttagtggatgcacagcaagcgagacgtattttagacaggcttgtcggatataaaatcagtccaatcttatggaaaaaagtcaaaaaagggcttagcgcaggacgcgtgcaatccgttgccctccgtttgattattgaccgtgaaaaagagattaacgactttaagcctgaggaatattggacaattgacggtacgttcttaaaaggtcaagaaacctttgaagcgagctttttcgggaaaaacggcaaaaaacttcctttaaatagtgaagctgatgtaaaagagattctttctcagctcaaagggaatcaatatacagttgaaaaagtaaccaaaaaggaacgcaaacgtaatcccgctttgccttttaccacttctaccctgcagcaggaagcggctcgcaagctcaatttcagagcgaagaaaacgatgatgattgcacagcaattatatgaaggaattgatttaggaagagaaggaacggttggtctgatcacgtatatgagaacggattcaacccgtatttcaaatacggctgttgatgaagcagctgcatttattgatcagacttatggaaaagagttcctaggcggaaaacggaagcctgcgaaaaagaatgaaaacgcccaggatgcccacgaagcaattcggccgacttcagttcttagaaaaccaagtgaattaaaagcagtcctcggcagagaccaaatgagactgtataaattaatttgggagcgttttgttgccagccaaatggcaccggctgttctcgatacaatgagtgtcgacctgacaaacaacggtttgacatttcgtgcaaatggaagtaaagtcaagttttccgggtttatgaaggtgtatgttgaaggaaaagacgatcaaatggaagaaaaagaccggatgctgcctgacttgcaagaaggcgacacggtattatcaaaagatatagaacctgagcagcattttacccagccgcctccgcgatatactgaggcccggcttgttaaaacccttgaagaacgcggtatcggccgtccatccacatatgctccgacacttgatactattcagcggcgcggctacgtggcattggataataaacgtttcgttccgactgaattaggtcagatcgttcttgacttgatcatggagtttttccctgagatcattaacgttgagtttacagctaaaatggagagagatcttgatcatgttgaagaaggaaataccgaatgggtcaagattatcgataatttctacaccgattttgaaaaacgcgtgaaaaaagccgaatcggaaatgaaggaagttgagattgaaccagagtatgctggagaggattgtgaattgtgcagttctccaatggtatataaaatgggacggtacggtaaattcttagcttgctccaacttccctgactgccggaacacgaaaccgattgtgaaacaaattggtgtgaagtgcccgagctgcggagaaggaaacattgttgagcgaaaatcgaaaaagaaacgggtgttttacggctgtgaccgttatccggactgtgaattcgtatcatgggacaaaccaattgaacgaaaatgcccgaaatgcggaaaaatgctcgtcgagaaaaaactcaaaaaaggcatacaagtccaatgcgtggaatgcgattataaggaagaaccacagaagtagcggtgagcagggtcttgctcaccttctttgtgtgttaaaagaaggccttgaataataaactaggagatgtgaaagatgaaccaacaaacagtgaatgtaatcggagccggactcgcaggaagtgaagcagcatggcagcttgccaaacgggggattcaagtcaaattgtatgaaatgcggccagttaaacaaacgcctgcgcaccatacagataaatttgctgaacttgtctgcagcaactctcttcgctctaatacgcttgctaacgctgtcggtgtattaaaggaagaaatgcgtgcacttgattcagctattatcgctgcggctgacgaatgttcggtgcctgccgggggcgctcttgcagtagaccgtcatgaatttgccgcaagtgtgacaaatcgggtgaaaaatcatccaaacgtaaccgttattaatgaagaagtgactgaaattcctgaaggccctactatcatcgcaacgggtccgttaacatctgaatcgctgtctgcccagctgaaggagctgactggagaggactatttatatttttatgacgcagcggcgccgattgtagaaaaagacagccttgatatggataaagtgtatctgaaatcccgttatgataaaggtgaagcagcatatttgaactgcccgatgacagaagaagagtttgaccgttttcatgaagcattaacatcagcagaaacagtgccgttaaaagaatttgaaaaagagattttctttgaaggctgcatgccgattgaagtcatggcaaaacggggtaagaaaacaatgcttttcggtccgatgaaaccggttggtctagagcatcctgttacaggaaaacgcccttatgccgtcgttcagctcagacaggatgatgctgcgggaacactttataatattgtaggattccagactcatttaaaatggggagaccaaaaggaagttctcaagttgattccaggacttgaaaatgtagaaatcgtcagatatggcgtgatgcatagaaacacatttattaactctcctagcctgttaaagccgacttatcaatttaaaaaccgcagtgatctgttctttgcaggccaaatgacgggagtagaaggatatgtggaatcagctgcctcaggacttgtagcaggcattaatgcggcgaagcttgtattgggagaagagcttgtgatcttccctcaggaaacagcaattggcagtatggcacattatattacaacaacaaaccagaagaacttccagccgatgaatgcaaactttgggcttttgaaagaattgccagttaaaattaaaaataaaaaagaacgaaatgaacaatacgcgaaccgtgcgattgaaacaattcaaacaatttcgaaaacaatataggtattgattgcaacctgagcgcgatttgtgataccatttaaaagcccttcctggggaggtattaggcatggagaatgttaagaatttcgtaaagttattcgttgaatatttacaaattgaaaaaaattattcacaatatactattgtgaattatgtggattcaattgaagaattcgagactttcctgcgcgttcaaggtataaatggatttgaagaagctgcatatcaagatactaggatttttttgacagaagcctatgaaaaaggtttatcgagaagaacaataagcaaaaagatatctgcattaagaagcttttataagtttctgatgcgggaaaagcttattgaagaaaatccgtttcagcttgttcatctgccaaaacaggagaaacggataccgaagtttctatatcaaaaagagcttgaggagctgtttgaagtttcagatataagccagccggccggaatgagggatcaagcgctgttagagctgctctatgccaccggaatgagggtcagtgaatgctgttccataactattaacgacgttgatttatttatggacactgtgcttgttcacggcaaaggcaagaagcagcgctatatcccctttgggtcttatgcccgcgaagcgttgaaggtatacatgaatagcggaagacagtgcttgctgatgaaggcaaaagaacctcatgatctattattcgtaaatcaaagaggcggaccgcttacagcccgtggcatcagacatattttaagcgggcttgttcaaaaagcgtcaagcactttacatatccatccgcatatgcttcgacatacgttcgccacgcatctgttaaatgaaggagcggatttgagaagcgttcaagaactgctcgggcattccaatctgtcttctacacagatatacacgcacgtttcgaaggaaatgttgagaaacacatatatgtctcaccatccaagagcatttaagaaaaattaaaggaggccctttatgtcatcttttcatgcgaccacaatatttgcagtacagcataaaggacgaagcgctatgtccggagacggccaagtaacatttggtcaggctgttgtcatgaaacacacggcacggaaagtgagaaaactgtttaacggcaaagttcttgctggctttgcgggatctgttgcagacgctttcactttattcgaaaagtttgaagctaagcttgaagaatataacggcaacttaaaacgggcggctgttgagcttgcgaaggaatggcgcagtgataaagtgctaagaaagctcgaagccatgctgattgttatgaatcaggatactttgcttctcgtatcgggaacaggcgaggtgatcgaaccagatgacggcattctcgcgattggatcaggaggcaattacgctttggcagcgggaagagcactgaaaaagcatgccggtgaaagcatgtctgcaagtgagattgccagagtcgcgttagaaacagcaggcgaaatttgtgtttacacgaacgatcaaatcatactggaagagcttgaatagaaaggacttgaggcgcatggaaaaaaaaccgttaactcctagacagattgtagatcggttagaccaatatattgtcggtcagcaaaatgcgaaaaaagctgtcgccgtggcattaagaaaccgctatagaagaagtcttctggatgaaaagctgaaggacgaggtcgttccgaaaaacattttaatgatgggtcctaccggcgtcgggaaaactgaaattgccagacgaatcgctaagctttcaggtgcgccatttatcaaaattgaagctactaaatttaccgaagtcggctatgtaggcagagatgttgaatcaatggtcagagatcttgtggagacttctgttcgtcttatcaaagaagagaaaatgaatgaagtaaaggaacaggcagaagaaaatgcaaacaaacgcattgttcgtctgttagttcctgggaagaaaaaacaatctggcgttaaaaatccgtttgaaatgttttttggaggcagccagccgaatggtgaagatgaggcggagagccaggaagaagcaaacatcgaagaaaaaagaaaacgaatggcgcatcagctggctttaggagagctcgaagactactatgtaacagtagaagtcgaagagcagcagccttctatgtttgacatgctgcagggctcgggtatggagcagatgggtatgaacatgcaggatgcgctgagcggattaatgccaaagaaaaagaaacggcgcaaaatgacagtcagagaagccagaaaagtcctgacgaatgaagaagcaagcaaactcatcgatatggatgaagtcagccaggaagctgttcagagagcagaagagagcgggattatctttatcgatgagattgataaaatcgcaaagaacggcggtgcatcttcttctgccgatgtttcaagagaaggcgttcagcgggatattctgccgattgttgagggctcaaccgttgtcacaaaatatggttctgtaaaaacagaccatgtattatttattgcagcaggagcgtttcatatggccaaaccgtctgatttgattcctgagctgcaggggcgtttcccgattcgtgtagaactgaacaaactcacggtagacgacttcgtgagaattttggttgagccggataatgcgctgctgaaacaatatcaggcattattgcagacagaaggtatatctcttgaattttctgacgaagctattcataagattgctgaagttgcttatcatgtgaaccaggacacagataatatcggtgcgagacgccttcatacaatacttgaacgcctattagaagatttgtcgtttgaagctccagatgtaacgatggagaaaataacgattacaccacagtatgtcgaagaaaagctcggaacgatagccaaaaacaaagatttaagtcaatttatattgtgaaaaatttaatatgaggaatgtttaggaggattatttatcatggctttattacaaaaaacaagaattattaactccatgctgcaagctgcagcagggaaaccggtaaacttcaaggaaatggcagagacgctgcgggatgtaattgattccaatattttcgttgtaagccgcagagggaaactccttgggtattctattaaccagcaaattgaaaatgatcgtatgaaaaaaatgcttgaggatcgtcaattccctgaagagtatacgaaaaatctgtttaatgtccctgaaacatcttctaacttggatattaatagtgaatatactgctttccctgttgagaacagagatctgttccaagctggtttaacaacaattgtgccgatcatcggaggcggggaaagattaggaacacttattctttcacgtttacaagatcaattcaatgacgatgacttaattctagcagaatacggcgcaacagttgtcggaatggaaatcctaagagaaaaagcagaagaaattgaagaggaagcaagaagcaaagctgtcgtacaaatggctatcagctcgctttcttacagtgagcttgaagcaattgagcacatttttgaggagcttgacggaaacgaaggtcttcttgttgcaagtaaaattgctgaccgtgtcggcattacccgttctgttattgtgaacgcactcagaaagctggagagcgccggtgttatcgagtctagatcattaggaatgaaaggtacttatatcaaggtactaaacaacaaattcttaattgaattagaaaatctaaaatctcattaatcacaaaaagaaccctttttgagggttctttttttatttcaaataaaggaaatcaataagctttatttcctgggttgaaagtctttctatgtaataattttaataaattttgcatttttcttcaaaaagtttcaaaaatgccgaaaagaaaggagaaaaaacagaaattctgctattttcaggcttatatcaaggcgagaaatgtagttctaacaatctaggactttatacctagttgtaaaatagataattgtgaggacatttttttacacgaacttcatagactttatgcctgttatttcttacaataagcatatagttttacaattctcgacaaggatattgagggtgaaaaaaactgaaatggaggtaagtggatttgagcttattttctggaacgatacaaaatcttgaaaatgccttgagtagagcggatattaagcaaaaagtcataactaataatatcgccaatatagatacaccgaactataaggcaaaaaaagtctctttccaaaatttattagatcaagaatcttcgcgtcttgaagcgataaaaacagactatcgtcatgttgatttttctgatgctgattcgaattattcaattgttgcgagcggagatacatcgtatcagcaaaacggaaacaatgttgatgttgacaaagagatgacagaattggcgcaaaatcaaatcaactatcaagctttggttgaaagaatgaacggtaaatttaattcgctgaagaccgtattaacaggaggaaaatgatgacagcttttcatagcttaaatgtttcagcatcggctttaacagctcagcgagtcagaatggacgttgtatcatctaacttagcaaatatggatacgacaagagctaagcaggtgaatggagagtgggtgccttacagaagaaaaatggtctcccttcagtcaaaaggtgaatcgttctcttccattctcaattctcaaatgagcggaagcgggaatgctggaaacggtgtgaaggtttcaaaaattacggaggatgattcggattttaatcttgtctatgatccgacagaccctgatgcaaacgctgatggatatgtacaaaagcctaatgttgatccattaaaggaaatggttgatcttgtcagcagcaccagatcatatgaggcgaatgtcacggcgatgaatgccacaaagggaatgctgatgaaggcgttagaaatcggaaagtaggtgaatgaatgtgattaatgcaatttctccttttcaggttcaaaatactcaaaacactcaaaatgcaacgaatcaagtaaacaatagccaaaaaacagattcttcaaatcaaacaagcttttcggagcttttaaaaaactctattagttcgttaaatgagtcccaagtagcttctgacaacatgactaatgccttggctgcaggaaaagatgtaaatcttgatgaggtcatgatcgctgctcaaaaagctagcatctctctaactgcagcaacagagttccgcaataaagctgtggaagcttatcaggagattatgagaatgcaaatgtagggggtctgacgatttagagaaagagtggaatgaccgggggttaacatgaatcgtactctaatgcaaatgaaaaacaaaacgagtgagttttggaaaaatagatctaaactacaaaagattttaatggttagtgctttagcggcaattattattattggaattattattagtgtttttgcttcaaattctaaaatggcgccgctgtacaaagatttgtctgctgaagaagcaggacaaatcaaaaaagaattggatgcaaaaaaagttccaaacgaactttcgaatggcggtacagtgattagtgttccggaggatcaggttgattctttgaaagtgcagatggctgcagaaggacttcctaaaacgggatcaattgattattcgttttttggacagaatgccggctttggtttgacagacaatgagtttgatatggtgaaagtgaaagctacacagacagaactgtcaaacttgatcaatgaaatggacggtattaaaaattcaaaagtaatgattaatctcccgaaagacgctgtgtttgtcggtgaggagcaatctgcagcatctgcatcaatcgttctgcagattcaaccgggttatacacttgatcaaagccaaatcaacggattatatcatctggtatctaaaagcgtgccaaacctaaaagaagataacatcgtcatcatggaccaaaattctacatactacgacaaatcagacagcgatgcagggtcctacgcggatagttattcttctcagcaaggaattaagtctcaagttgaaaaagacattcaaaaacatgtacagtcactgctgggtacgatgatgggccaagataaagtcgttgtctccgttacagcagacattgatttcacaaaagaaaatcggacagaagacattgtcgaacctgtggataaagaaaacatggaaggcattgcagtcagcgctgaaaaggtatctgaaacatatcagggcgacggtgcagccaacggcggaactgccggaaccggcgaggaagatgtaacaaattataaggctgacggtgaaaataccgaaagcggaaactacgaaaaaaacagcaacaaaatcaattacgaggttaaccgaattcataaagaaatcgctgaaagtccttataaggtcagagatttagggattcaagtaatggtagagccgcctgatgccaaaaacacagcgtcgctatcaactgaaagacaggatgaaatacaaaaaatcctttcaactgtagtcagaacatctttggataaagatgaaacgcaaaaccagaatttatctgatgctgatatcaataataagattgttgtctccgttcagccattcgacggcaaagtcaatttggatacaaatacggaaaaatcctcaggtatcccgctgtgggcatatattgtaggcggtgttttaatcgcagcgatcattgttctgatcattatgcttatcagaaagaaacgggcgcaagaggatgaatttgaggaatatgagtatgaggttcctcaagaaccaatcaatttgcctgatatcaacgaagaggaaaatgaaacagcggaatcagtcagacgaaaacagcttgaaaagatggcgaaagacaagccggaagattttgcaaaactgctgagaagctggctggccgaggattaggaggaattagaaatggcgagacgtgatcaagataagcttacaggaaaacaaaaagcagccattctcatgatttccttggggttagatgtgtcagcttctgtctataagcacttaaccgatgaagaaattgaaaggcttactctggaaatatcaggtgttcgaagcgtcgatcatcaaaaaaaggatgaaatcatagaagaatttcataatatagccattgcgcaagattatatttctcaaggcggtttaagctatgcaagacaagttctggaaaaggcgcttggagaggataaggcggagaacattctaaacaggctgacttcttctttgcaggttaaaccatttgattttgccagaaaagcggagccagaacaaattttgaattttatccagcaagagcatccgcagacgatggcgttaatcttgtcttatttagatccagtgcaggccgggcaaattttatccgagctgaaccctgaagtgcaggctgaggttgcgagaagaatcgcggtcatggatagaacgtctccagaaataattaacgaggtagaacggattctggaacaaaaattatcttctgcatttactcaggattatacacaaacaggcggaattgaagctgttgtggaagtgttaaacggggtagacagagggacagagaagacgatcttggattcattggaaattcaggatcccgatcttgctgaagagattaaaaagcggatgtttgtcttcgaagatattgtcacacttgataaccgtgcaattcagagagtcattcgcgatgttgagaacgacgatttgctcctttcattaaaggttgcaagcgaggaagtcaaagaaattgtgttcaacaatatgtcacagcgtatggttgaaaccttcaaagaagaaatggaatttatgggccctgtacgcttgaaagatgtagaagaagcacaatcgagaattgtaagcatcgtcagaaagcttgaagaagccggtgaaattgtgatagcaagaggcggaggggatgatattattgtctaatatcattaaacaagaatcatctatttctccacaaaaggaaaaaagaaaactttctatacaagaggtgcgtattgatcattctcaccttttgcaggctgaagagaactcggaggcgcttatggcccgagtgaaagaggaagctgaccggatttctgagcaggcaaacagtcatatagaaaatattcgccgtcaaatcgagcaggagaaaaacgattgggcggctgaaaaacagaagcttattgaagaagcaaaaaccgagggctttgaacaaggagtagcgttgggcaaagctgaggcattgcaacagtatgccgaactgatcggccaagcgaacagtataactgaaatgtccagaaaagctgttgaggacaagcttgaagacgctaatgaagaaatcgttgagcttgccgttgccctagcaaaaaaagtttggcagcaaaagtctgatgataaagaggctttcctcctgcttgtacaacaggttataaacgaagtgaaggaatatgacgatatatcaatttatgttgatccatattactatgagacaatctttcagcaaaaagatgaaatccagcagcttctttataaagaatgccggcttggcatatatgctgatgaaaaagctcaaaaaggaacctgttatattgaaactccttttggcagggtagatgcgagtgttgacacacaattgatgcaattgaaagataaacttctgacagcgctggaagcaggtgcagctgaatgaagacacagagtctgatagattgtatagaaatgacagactcgtataaacggtacggaaaagtcaagcgggtaatcggcctgatgattgaatcaaaagggccagcaagctcaattggcgacgtgtgcctgatttatgcaaaaggacaatctgggaaagtcattaaagctgaggtagtcggcttccaggaagaaaatattttgcttatgccttatttagaggctgcgagcattgcacctggcagcattgtagaagctactggggaatcacttcgggttaaagttgggaccggactgatcggacaagtcatcgatgcttttggagaaccgcttgacggaaagcttctgccgaaagggctttcgcctgtatcaacggagcaatcaccgcccaacccgatgaaacggccgcctatccgtgaaaagatgggtgttggagtcagatcaattgacagcttgctgacagtcggtaaaggccagcggattggaatttttgcaggaagcggtgttggaaaaagcaccttaatggggatgatcgccaagcagacagaggctgacttaaacgtcattgcacttgtcggagaacgcggacgagaggttcgggagtttattgaaaaagatctggggaaagaggggctgaaacgatcgattgtagtcgttgccacctcagaccagccagcattaatgagattgaaagcggcatatacagcgactgccattgccgagtatttccgagataaaggccaaaatgtcatgtttatgatggattctgttacaagggtggcaatggcgcagcgagagattggactggctgcaggagagcctccgacgacaaaaggttatacaccttcagtgttcgctattttacctcgtttactagaacgaacaggtgcaaacgagcatggaaccattacggcattttatacagtgttggtagacggggatgacatgaatgagccgattgccgatactgtacgcggaattttagacggacatattgtgttggacagggcgcttgccaataaaggccagtttcctgcagttaacgtactaaaaagcatcagcagggtgatgtcaaacatttcaacaaaacagcatctggatgcggcaaataaattccgtgaacttttatcgacatatcaaaattcggaagatctcattaatatcggagcttacaaaagaggatcatccagagaaattgatgaagcgatacaattttatccgcagcttattcaatttttaaagcagggaacagacgaaccggctttattggaagaaagcattgctgtattaactagtttgacaggaaatgaggaataaacgtggcttatcaatttagattccaaaagctgctggaactaaaagaaaatgaaaaagaccaatccttatccgagtatcagcaatcagtttctgaatttgaaaacgttgctgaaaaattatatgagaatatgagcaaaaaggaattgctggaacaaaataaggaaaagaaattaaaaagcggcatgagtgtacaagaaatgaggcactaccaacaatttgtctcaaatcttgataatacgatctatcactatcaaaagcttgtcattatgaaaagaaatcaaatgaatcaaaaacaagaaattttgacagagaaaaacattgaagtgaaaaagtttgaaaaaatgcgtgaaaaacagtttaaaatgtttgctcttgaagataaagctgcagaaatgaaagaaatggacgatatttcgattaagcagtttatgattcaaggccattaggagcgaatgtaatgtccggcaaaaagaaagaatcaggtaagttccgttcggttttgcttatcattatcctcccgctgatgtttctattaatcgcaggggggattgttctttgggctgctggtatcaatgtcataaagccgatacaggatgctgcggcaaaaacgccggttcttaaagaattggtccctgaaaccgaaaataaaaaaggcgcagcatcaagtaaggatagcagtaatacggcagctctggaaaagaccattaaggatcaaaaaagtgaaatcagtatattgaataaagatttagaaacaagtaaatcagaaatcgataggctcaatcaaaagatccgttcacttgaaaagacggctgaggatcaaaaaaagtcatcagaagatcatactgaaggatcagcagactcgaaagcttcttctgaaaatgacaaagtgatcagtgtgtacaaaagcatggacagcggaaaggctgctaaaattattgcccaattaaaggagcaagaagcactgaaaatattgaatggcctaagcaaaaagcagcttgctgacatattggcgaaaatgactcctgagcaagcagcaacctatacagaaaaaattgctgccagccaagaatagggggaatgaaaggtgaagctgcttgaattagcgggacctttgctgcaaaccacaacgggttctgccgctaaaaacatgaaaagtagccaaggagtttttcaaaactggcttatgtctgaggctggattgaaggaactctcagaacaaggaaagggtactcctaattccgaagatcagcttttagcagatgcgcttaaaaagatcggtgaatggctaaatgcaagtcctgaagatcaagacaaacaaaatgcgaatcttttgcaaacattaagcaaactgacagggaaacaattggatgcgaatgctctgcaaatgttgcaaaatcttttgcaagcagttaaatcaaaaatgtcaggcgggacggaccagttgctcacagatacggagaaaatcttttcagaagctaaaacggctctgagtgccaatgattctgcttctgacattaatggagcactgaagtctgatacagagcaatcaaatcatgaaaatgaagtatccgagcctgctaaagagcttatctatatccagatgttcattagccagctcgtagaagggaataatctgactgatcgcgggaatggcaatgaagctcatgccatttaccaaaatggagatcaattcctttctgcattagaaaagaagggtgtatctcaacaaataattcaggatcttaaacagcaaatattcactaaagctgagtcaagttcaaaactttactcgatgacagcgtcagagctgaaaagttttcaaagcttaatggatcaaatgtctatgcttcctcaaaaagggaccaaagaatggagtttagctgaaagccagctgaaagccttcttgttatcgaaatcatccgaatcatcacaagactttgggaagcgtgttctcacaccgctctcgcagagtttatccagcaaaaatgcatcggatgtttctggaagtattcagcctgtagatagtaaatcaggactccaaatgctgttttcgggttatcggagcataggaggagtacaaacacttgatctgcagcagatgtcatctgatataccaaataccgaaacaaaaacggtggctgatcaagtgattaatgcgtggaagcagatgaaatatacgcctttcggcagatcgacgggaagtttcactattcggctgaaccctgaacatttaggatttgtcacaatcaagctgacaaatgaaaatggaatgtttcagagtaaaatcatagcatctagccaatcagcaaaagaattgcttgaacagcatcttcctcagctgaagcaatcattgccgaatatggccgtccaaattgaccgttttactcttccggtccaaagcggggatcagccgatatacggccagcttgctgatgaacagaaacagcagcaagaggggcagagacagcaaagacagaaaaagcaatcaaatgattttggcgatctgctcgatgaagtgtcgatggttgaaatggaggaagaagaatgacttctataagttcagaatataaactgcctgaaaaaacgaacactgtgtcgacgaacaacagcagcttggggaaagacgagtttttaaaaatattaatgactcaagttcaaaaccaagatccgcttaacccggttgacgataaagaatttatcagccagatggcgactttttcaagcttggagcaaatgatgaatctgaatacgacaatgactcaattcgttgaaaaccaagatccgtttacaacgtatgttgattggatgggaaaagaagtatcttggactgatggtaaaagtgcaacagataaaacaggcacagtaagctctgttaaacattttaaaggaaattattatctcgttcttgatgatgggaccgagatcagtcctgcgaatgtcatgtctgtgggacaatcatctaaataaaaacatctgggggaatatattatgttacgttcactttattctggaatcagcggtatgaaaaactttcaaacaaagcttgatgttatcggcaataatattgccaacgtaaatacagtaggattcaaaaagagccgtgtgacctttaaagatatggtaagccaaacgattgccggcggttctgctgctggtgcaacaatcggcggaacaaactctaagcaaatcggtttaggttcatcatctggcacaattgatacaattcattcaacaagcgcgacacaaagtacaggaagaacacttgatttagcaattgacggcgacggttacttccgaattgatacaggtgacgggacagcttatacaagagcagggaacttctatttagataataccggaactctggttacaggtgatggctaccatgtgttaaatatgaatggcggaacaattaaaattcctactgatgcacaaagtttcactatcggttctgatggcaaggtatcgatcgttgatgccggtggtcaatcacaagacggcggacaaatcgggattgtgacttttgccaacagtgatggattggataaaatcgggagcaacttataccgtgaatctttaaactctggtacggccagtgcagcgaaccagcccggtgatggcggaacaggttcccttaaagtaggatttctcgaaatgtctaacgtcgatttaactgacgaatttactgaaatgatcgtagcccagcgcggattccaatcaaactcaaaaattattacaacatctgatgaaatccttcaagaactggttaaccttaaacgttaaggagggaggggaggcgagtaatcgcttctccgctgttttatgattaaagtaacccgtttgaacgggcagccctttacactgaatgcgctatttattgaacagattgaatgttttccggatactacaattactctgtcaaatggtaagaagtttgtagtaaaggaagatgaagaagctgttctggaaaagatcgcagctttctaccgaaaaatacaaatattttcaatggatcaaggaatagaggaaccggaatgaagaaaaagttaatgatcatattactaattattcttatcgtaattggtgctctcggggcggcggcttattttgttttaggcggaaagtccgaaaaaagtgaagcgaaaaaaagtattgatgaaatcgttgcgtcttctgttgatgtagaagagatcacaacaaatttaaagtctgataacattatccgtcttgctattaaacttgaaactgattctgataaatcaaaagaagaacttgagaaacgtgatttccaagtgaaagacgctgttatatcactgcttgctgatacgaatgctgatcagattgagggagacaagggaaaagaaacctttaagaaggaactaaaagataaaataaatagctacctccaagaaggaaaagtagaaaaagtgtatattacctcctttaatctgcaataaagcataatttgacagaatacggaggtgaggaaaatgtcaggagaagttctctcccaaaatgaaatagatgcactgctttctgcaatatcaacaggtgaaatggacgctgaagagctgaaaaaagaagaaaaagagaagaaagtcaaggtttatgatttcaaacgtgcgctgcggttttctaaggatcagatccgcagtttaacgagaattcatgacaattttgcaagacttcttaccactcatttttctgctcagctcagaacctatattcacatatctgtcagttctgttgaccaggtcccgtatgaggaatttatcagatcgatcccgaacatgacgattctgaatctatttgatgtccatccgatggaaggcagaattatgatggaggtcaaccccacgatagcttatacgatgatggatcgggtcatgggcgggattggaatcagtcataacaaggttgacagtttgacagaaattgaaacaaaaatcatttctaatttatttgaaaatgcactgggtaattataaagaagcttggcagtcaattgctgatattgaaccggaaatgactgagtttgaagtgaatccgcaatttgttcagatggtatctcctaatgaaacagtcgtggtgatctcgctcaatactcaaattggtgaaatcagcggtgtcattaatctctgtatcccgcatatcgtactcgagccgctcataccgaagctttcagtccactattggatgcaatcagaccgaaatgagccaaagcctgaggaaacaaagtcgcttgaaaaacgtatcatgacagcacaaatacctgtcgtggccgagctcggcacatctgaactgacgatagaagagtttttaagtttagaagtcggagactgcataactttggacaaatcagtcacggatcctcttactgtattggtcggagataagccgaaatttttaggacaagccggccgggtgaatcgaaaacaggcagtgcaaattttagatcacgacataagaggtgaacaagatggagaataatagattatctcaagatgagattgacgcgcttcttaacggtactggcagcacgcttgatgagccagaggttccggaagtagatgacttatcggaaatggagcgtgatgcgatcggtgaaatcggtaatatttcattcggcagttctgcgacagcactttcaacgcttttaaatcaaaaggtcgatattacgactccaagcgtaacggtcattccaagaagtaaaatcagcgatgcgtttcctgaaccgtatgtagcgattgaagtgaattatacggagggcttcagcggaagcaacctgttagtcgtggaacaaagtgacgcggcgatcattgctgacttaatgatcgggggagacggaaaaggtgcggacccttcactgggtgaaatccatttaagtgcggttcaagaagcaatgaaccaaatgatgggatcggctgccacatcaatgtctactgtattcagtaaaaaaattgatatttcacctcctcgggttgaattgctggatgttactgaagaaaagggtacagaccgtattcctgatgatgaaatgctggtgaaagtttctttcaacttaaaggtgggagaattaatagactccagcattatgcagctttacccattgacatttgcgaaagatttaatttcaagccttatgaactcagaaagtgcagaggaagaagaaacggtgcagcccgaagttacatacgaacagccgaaagagcctgtgacgccagagccgcgtattgaaccgaagcaacagcagcagccgtcaaaaaggcagggaacagcaaaaaaagcagcgccagttcaggtttcaccggtggaattttcagcgtttgatccaaacgaagctgtacaagcccctattcataatctggatatgcttttggatatcccgctttcgattactgttgagcttggcagaacgaagagaagcgtaaaagagattttagagctttctgccggaagtattatcgagcttgataaattagccggtgagcctgtagatattttagttaatcagcgtatcgttgccaaaggcgaggtcgttgtcattgaagaaaacttcggagtgagagtcactgacattttaagccaggcagagcgcattaataatttaaaataacgaaacacaaggagagagatagattatggcacatagaattttaattgtagatgacgcagcatttatgagaatgatgattaaagatattttagttaaaaatggttttgaagttgtggcggaagctgaaaatggagcacaagcggtagagaaatataaagagcattcacctgaccttgttactatggatatcacgatgccagaaatggatggtattacagcattaaaagaaattaaacaaattgatgcgcaggcaagaatcatcatgtgttctgctatgggacagcaatcaatggttattgatgccattcaggccggcgctaaggatttcattgtgaaacctttccaagctgaccgtgtgcttgaagcaatcaacaaaacattaagttaaagggtgtacgactgttgaaaaagagtcaatattttatcgtttttatttgttttttcgttttattgagtgtacatccgattgctgctgccgcggcagactctgataattcaactgtaaacgaatggtttcaaaagaaagatgaaaaaactgcagatcaatcagagcaaaagaaagaaaaaacaacaaaaactgctgatgagacggagggagcggctgctccttctgtctcagcttttgattttgtaaagatgattttcgctttattgtttgttatcgtgctgatttacgggctggttaagctcatgaacaaaagaaatcggctcctaaagccttttcaatatgttgaaaatattggcggcacatcggtcggccagaacagatccatacaattgatcaaggtcgggaaaagtgtgctcgtcgtcggtgtaggagagacgatccagctgctgaaagaaattgaggatgaaaaagagattgaagtcattctcagtcagcatgaagaggcaatgtcaagcaaaatagagtggcaaaagtttgtgaagccgcttaagagttctgaacatcagccgcagcaaaaactgccttcattttcaaaagcattaaaagagcaacttgaagagttaaaacaaaaccgttctgaaggaaagaagaaaggcccacgtcatcatgaatgagtttataaatattttcagttcaagcgatccggaaaacgtaagttcgactgttaaattactattattgttaactgtattttcagtggcgcctggaatattgattcttatgacttgttttactcgcatcgtcattgttctgtcatttgtcagaacttcacttgcgacgcaatctatgcccccaaaccaggttcttatcgggcttgcgctgtttttaacattttttatcatggctcctactttttcagaaattaataaagaagcgctgaccccattaatggacaacaaaatcagcttggatgaagcgtatacgaaagctgaggaaccgattaaagaatttatgagtaaacacacaaggcagaaggatctggcgctgtttatgaattacgcgaaaatggataaacctgaatcattaaaggatattccgttaacaacaatggttccggcttttgccatatcggagcttaaaacagcatttcaaataggttttatgatttttatcccttttttaattatagatatggtagtggcgagcgtcttgatgtcaatgggaatgatgatgctgcctccagttatgatttctctgccctttaaaatattactttttgttttggtagacggctggtatttaattgtgaaatctttgcttcagagcttttagggtaggtgctaaacgtgagttcagaatttgtaatttctatggcggaaaaagccgtatacgtaacgctgatgatcagcgggccattattggctattgctttactggtcggtttaattgtcagcatatttcaggcgacaactcaaatccaggaacagactttggcgtttattccgaaaatcgtggcggttctcctggctctcattttttttggtccgtggatgctgtcgacgattctttcatttacaacagagctgttttctaatttaaatcgttttgcagggtaatgtagagatgaattcaattattgacttatttcctgcttttttattggtttttattagaatctctgctttttttgtaacaattccgctatttggacatcgaaatgtgccagctgttcatcgcataggttttgctttttttcttgcggtcatttgtttcagcaccattgataaaccgccctctttggagatagatgagcactatatgcttttggcgtttaaagaagctttggtcggcctatgtctgggtttaattgcttatatgatgattgccgcagtgcagattgccggctcgtttattgattttcaaatgggattttcaatagcaaacgttattgatccgcaaaccggtgcacaaagtccgttgattggccagtttatctatacgatggcacttttgtttatgctgagtgtcaatgcccaccatttgttgctggatggtatttactacagctttcagtatatttcagttgatcaggcatttccgaatttcggcgatgaaaagtttgcctattttattgcgaaaagctttaatgcaatgtttattatcgcttttcaaatgtcagcgccggttgtggccagcttgtttctagttgatttagcattaggcatcgtggctcgaactgttccgcagttaaatgtatttgtggtcggtctccctttaaagatcgctgtcagtttcatcatgctcattgtatgtatgtccgttatcttcgtcgttgtccggaatgttttcagtttaacgattgaaacgatgcggaatcttttagcattggtcggtgtttcttaatgaagcttagagttgacctgcagttttttgcgggagagaagacagaaaaagcaactccgaaaaaacggaaggatacgcgaaaaaaagggcaggtagccaaaagctcggatgtcaataccgccgtttctttactggtaatattcctttcgcttattgcaattggtccgtatatgagagacaggctgctgtcattcatagaaacattttataccgaatcgctcacaatgaagctctcagaatcaaatgtgcatacattgtttgtcagcttattaaaggatatgggcataatactcgcaccgattttgcttgttgctcttgttgcaggagtcgtaagcaactatatgcaggttgggttcttattttctgctgaagtgatacagcctaagcttgaaaaactggatccgatcaaaggctttaaacgaatatacagtatgagggcgattgtagagctgattaaatcaattttgaaaatcgtagtcgtcggttttgcggcttttgctgtgctttggctgcattatggagaaattctccggcttcctctcctgacacccgaagaggcactatctttcgtttcaaaactcactttgtggatgggactaagcggtgcaggcgctttattaattcttgctggtcttgactatttatatcagagatttgattatgagaaaaacatcaaaatgtcaaaacaagatataaaagacgagtacaaaaaatctgaaggtgacccgattattaagtctaaaattaaacaaagacagcgggaaatggcgatgaggcggatgatgcaggaagttccaaaagcagatgtcattatcacaaacccgactcactatgcgattgctttgaaatatgatgaagaaaaaatggacgctccttatattgttgcaaaaggtgtcgaccacctggcgttaaaaatcaggaaaattgctaaagagcatgatgtcatgatggtagaaaacagaccgcttgcccgtgcgttatatgatcaggtggaaattgaccaggcagtgccggaagaattttttaaagttttagcagaaattctggcttacgtatataaaacaaaacaaaaagtatattgaatttttcgatttaaaaggagagaaaaaacagcatgtcaacaagagatttatccgttttaataagtgttgtcctcattgtggcgatgctggtgattccatttcctccatggctgttaagtattttgatcattattaatatttctcttgcgttgatcgtgcttctcaccacaatgaatatgcaggaagcgcttcagttttcgatttttccgtcactgttgctgcttttgaccctatttcgtttgggcttgaacgtctcaactacccgttcaattctttcacacggtgaaggagggaaagtcgtcgagactttcggaaatttcgttgtcggcggaaatgtattagttggactcgttgtatttatcatccttattattattcagtttatcgtcattacaaaaggtgctgaacgtgtttccgaggttgcagcaaggtttacgctggacgcaatgccggggaagcagatgagtattgatgctgatttaaacgcagggatgattaccgaacaggaagcgaagcatcgccgcgaaaaagtggcaagagaagcagacttttatggagcaatggacggtgccagtaaatttgtaaaaggtgacgccattgccggaatcatcattgtgatgatcaatattattttcggaatcgtgatcggaatgcttcagcagggcatgtccattcaagaggctgcttcacactttacgatgctgactgtaggggatggaattgtttcgcaaatcccggcactgttaatttctacggctacgggtattgtggtcacaagagctgcatctgaaggaaacttagggcatgacattacaggccagctgtttgcgtatccaaagcttttatacgtcgcagcagctacgatcatgcttttaggtattttcactccgatcggcatccttctgacggggccgcttgcgggattgcttgcttttggcgcatatacactatctaaatcaggtaaggaaaaagaagaagtggatgagattcttgaggaagaggctgaggtggacgagcttaaaagccctgaaagtgttgttcagcttctgcatatagatccgatagaatttgagtttggatatggcctgataccgcttgctgatgccaatcaaggcggtgatttattagaccgaattgttatgatacgccgtcagttggctttggaactcgggcttgtcattcctgtcgtgcgaatcagagataatatagcgttgcagcctaatgaataccgattgaaaattaaaggaaacgaagtagcaaaaggcgagctgttgcttgatcattatttagcgatgtcgcctactcctgaggacgatctcattgaagggattgaaacagtggagccttcattcggtctgccggctaaatggattagcgaagcggtaaaggatgaagccgatatgcttggttatacagtagttgatcctgcatcagtcgtttcaacgcatattacggagaaaattaagcagcatgcccacgaattgatcggaaggcaggagacaaaacagctgatcgatcacttgaaagaatcgtatccagtcctggttgaagaggttacgccgaatccattgtctgtcggtgatattcagaaagtgcttgctaagcttttaaaagaaaaagtttcaattcgaaacttagtaacgatttttgaaacacttgctgactatgggaaattaacaacagattctgatctcttgacagagtatacaagacaagcgcttgctaaacaaattacagcccagtttgccaaagaaaatgaagtgttgaaggttgttacttgttccggccgtgtagaaaaagcaatagcagacggtgtgcagcagacggaacacgggaactatttatcacttgaaccagatatttcagaaagtatagtgcgctctgtcgctaaagaagctgaacagctctcattacgtcaggaaaccgcgattcttctttgctcgccgcctgtcagaatgtatgtgaagcagcttctggaacggtacttccctgatcttccggtactctcttataacgaacttgaggcgaatgttgaggtacaaagcattggagtggtggatatttaatgaaaataaaaaaatttactgctgcttcaatgcaagaagctgcacttctcatcagaaaagagttaggtaatgaagcggtcatattaaattcaaaaaaaattaaaaagcgaaaatggtttggcctcatcaacaagcctgctgttgaagtaatcgccgtattggatcaggactttcttgagaaaaaaacgcctcagaaggcagctgaaccgaaacaaacattaaaaactccggtcagcagtccgaaaatagaggagagaacatatccccctcaaattccggcgcaacaggagctaggtgatttttcagcatatcaatctgtacttcctgagccgctgcgaaaagcagaaaagcttttgcaagaaacagggatcaaagagtctacgaaaacgaacactctgaaaaaattgcttcgcttctctgttgaagcaggcggcttgactgaagaaaatgttgtcggcaaacttcaggaaatactatgcgatatgctgccctcagcagacaagtggcaggagccaattcattcaaaatatatcgttctctttggttcaacaggggctggtaaaacaactacactggctaaactcgcagccatatctatgcttgaaaaacataaaaaaatcgcttttattacaacagatacgtatcgtattgcagctgttgaacagttgaaaacatacgctgaactgctgcaggctcctctggaagtttgctatacaaaagaagaatttcagcaggcgaaggagttattttctgagtatgatcatgtgtttgttgatacagccggaagaaacttcaaggacccgcaatacattgatgaactgaaagaaacgattccttttgagagcagcattcagtcatttcttgttttatccgcgactgcaaaatatgaagatatgaagcatattgtcaaacggttttcatccgtccctgtcaatcagtatatttttacgaaaatagatgaaacgacttccttaggttctgtatttaatatactggcagaatcaaaaataggtgtcgggtttatgacaaacggacagaatgtgcctgaggatatacagactgtatctccacttggttttgtgaggatgctgtgcagatgaacagatatgaccaagcagcaactttacgggcgaaaatggaaaaacgtgagcgcgttctgccaatggtttattcacaaaaagcgaagacacttgctgtcatcagcggcaagggcggtgtcggaaaatccaatattaccttaaatatggcacttgcgctccaggataaaggtaagaaggtgctgctcatcgaccttgatatcgggatggggaacattgatatattaataggaaattcatcgtctgccacgataattgatgttttaaccgatcgtaagcctttgctccagtcattatccattggcccaaagggtttgcggtatatatcagggggaaccggtcttgatgtgatgtttcagctcgatcagagaaaatggacgttttttgccaatgaactttctcatgcattaagccagttcgattatgtgctgtttgatatgggagcgggtttatcaaaagatcaactgccttttattttatcagcagaagatattttgattataacaactcccgagccgacggccattatggacgcatacagcgctgtcaagcacttggttttgacagaaaataagctttcaatgaaggtggctgtcaatcggtgccgtgaccaaaaggaagggcttgacgcttttgcccgcctctcccgtacaattcatatgtttttggatgttcaggttcagtttgccggttccgtttctgacgatgtgatcgtgagcaaagcggttgtcgaacaggttccttttttcataaaaagccctcaggcaaaagccagccggtcagtccgtattttagcggacgccttgtttggaagagaagaaacgagacacaaagaagacaaacagacatttattgagaaattatcttcttttttaatgaggagggcttaatttgattcgtgtgcttgtagttgatgattcagcttttatgagaaaaatgataagtgattttctgaccgaggaaaagcagatagaagtaatcggaactgcgagaaacggagaagaagcgcttaagaagattgaattattaaaaccggatgttattactcttgatgttgaaatgccggtcatgaatgggacagatacgctccgcaaaattattgagatttataacttgccggtcattatggtgtctagccagaccgagaaaggtaaagaatgcacaattaattgtttggagatcggtgcctttgactttatcacaaagccatcaggttcaatatctctggatctatacaaaattaaagaacaattagttgagcgtgtcgtcgcggcaggactttccggcaagcggaaacgtcctgtttcccagacagttcggcccgaacctattgtgcgtgctgtcgttaagcctgaattaagcaaaccgaaacctggcacgggcagacaaattgtgtgtatcggcacatcaacaggcggtccacgagcgttacaaaaggtgataccgaagctccctaaagatttgaacgcaccagtggttgtcgttcagcacatgcctgaagggtttactgcttctttggctgatcggctgaatcatttatctgacattcaggtaaaagaagcaaaagatggtgaagcagctcttaacggctgtgtttacatagcaccgggcggaaaaaacatatccgttattaaaaacagcgaaggactccaggttgtgcttgataaccatgacaccccaagccgtcataaaccatctgctgattatttattccgttctgtcgggaaactgacagattatgaaaaagtagcggttatcatgaccggaatgggcagtgacggcactgctgggctaaaggacatgctaacagccggcaatgtgaaagccattgcggagtctgaagaatcttgtgtcgtatacgggatgccaaaagctgctgttaaagcgggtctcattcatgagattaaacatgtggaagatatcgcagcatccatcacaagctgtgtgaaaaaagagagggtgtgattcaaatggatatgaatcagtatttagatgtctttattgatgagagtaaagaacatttacaaacatgtaatgaaaagcttcttcttttagagaaagacccgactgatcttcagctcgtacatgatatattcagggctgcccatacattaaaaggaatgagcgcaacgatgggctacacggatttagcacacctaacccatctgcttgaaaacgtgctggatgcattccgaaacggagacatggcagtcacctcagactggctggatattttgtttgaagctctggatcacctggaagcaatggttcagtctattattgatggcggggatggtaaaagagatatctcagaagtgagtgccaagcttgatgtgaatggtgcgcacgctgaatccgctgcctccgcggaacttgcagaagcacagagttcagcatctgattgggaatatgatgaatttgaacgtacagttatacaagaagcggaggagcaaggcttcaaacgatatgaaatcaagatttctctgaacgaaaactgtatgttaaaagcagttcgtgtctatatggtgtttgaaaaactaaatgaagtcggagaagtagccaaaacaattccaagtgctgaagtgcttgaaacggaagattttggaactgattttcaagtttgtttcttaacacatcaatcagcggaagacattgaacaattaatcaatggcgtgtcggaaattgagcatgttgaagtcattcaaggggctcctttaacatcagccgaaaagcctgaagaatctaagcaagaagattcaccagcagcagctgtacctgcgaagcaggagaaacaaaaacagcctgctaaaaacgatgagcaggcgaagcattcagccggcggatctaaaacaattcgtgtcaacattgacaggcttgattctttaatgaacttatttgaagagcttgtcattgaccgcgggcgtctcgagcagattgcgaaagagcttgagcacaatgaactgactgaaacggttgaacgaatgacgagaatttccggagatttgcaatcgattattctgaatatgagaatggtcccggttgaaactgtttttaacagattcccgagaatgattcgccagcttcagaaagagctgaataaaaaaattgaactctcgatcatcggtgcggaaactgaactggatcgtacagtaattgatgaaatcggagatccactcgttcacttgatcagaaacagtattgaccatggtatcgaggcgccggaaacacgtttgcaaaagggaaaaccggaatcaggaaaagttgtgcttaaagcttatcacagcggcaaccatgtctttatcgaagtagaggatgacggcgcaggccttaatcgcaaaaaaattctggaaaaagcgcttgagcgcggggtcataacggaaaaagaagctgaaaccttagaagacaaccaaatttacgaattgatttttgctccggggttctcaactgctgaccaaatttctgatatttccggccgcggtgtaggacttgacgttgtaaaaaacaaactggagtctcttggcggttcagtcagtgtgaaatcagccgagggtcaaggctctctattcagcatccagctgccgcttaccttgtctattatttcagttctgctgattaagttggaagaagagatatttgccattccgatttcttcaatcattgagacagcagttattgacagaaaagacattttgcaaacgcatgaccgtgaagtgattgactttagagggcatattgtccctgtcgtttatttaaaagaagagtttaaaatagaagatacaagaaaagatgcggaacagctccatatcattgtcgtgaaaaaaggcgacaaacctactgcatttgtggtggactcctttattggccagcaggaagttgtgctgaaatcactcggagattatttaacaaacgtctttgcaatttccggagctactattttaggagacggagaagtagcgctcattattgattgtaatgcactgattatttaaccattcgaggaggtgtctcacatgactgcagaaattaaaacaggcgaaaaaatgatagtctttatggtaaatggcaaagaatatgccatttccgtcactcaggtgaaatcaattgaaaaatggcaaaagccaacgagggtacctggcgtcgaaccatatatttgcggggtaatcaatttacgcggggtggtgactccggttattgatttaagaaaacgcctgaatttgccagagtatgaaattaccgatgaaacacgaattatcattattgcttatcgtgatattgaagtcggctggattgtggatgaagcgaacgatgtgattaccgtacacgaaagtgaaatagaatctgctccagaaggcgttcagaaagatacggatgtgtcgatcgaacagattgtgaaacaagagaacagactcttaaatattattgatgcgaacgcggttttggataaagaatcatctcagtccgctgtgcccgatcaagcttaatcttaaaggggttatgacatgagtatttttaatggaatcaaagaagagcagatggacattttgcgggaagtcggcaatataggcgccggccactccgcctctgcaatggcccagctgttaaatagaaagatagatatggaagtcccatttgcaaagctgctgtcttttgatgagcttgttgattttttcggcggcgccgatgtcccggttgccagcatctttttaagaatggaaggcgatttaacgggttcaatgttctttataatgcctttttttcaggcggagcagtttatcagagagctgattggaaaccccgattttgacatagaggacttaggtgaagaccacatgagctcatccgctttgcatgaactgggcaatattttagcggggtcatatttaacagctttggcggatttgacgaaactccagctctatccaagtgttcctgaagtctctttggacatgttcggagcagtgatcagcgaagggctgatggagctcagtcaggttggagaacacgccattgttgtcgacacgtcaatttttgaccaaagccatcagcaggagctgaaagcgcatatgtttatgctgccggactatgattcatttgaaaagctctttgtcgccttaggtgcatcattatgagtacaactgaggctgttgttataaaggttgggattgctgacgtgaagatcgcccgcttcccggataccatccggacctctggtttgggctcatgtgtggggctggtgctttatgataaagaaaagcaaacggcgggtcttgttcatgtcatgcttccggattcgacgttatcgaaaactgccgagctcaaccgggctaagtacgctgacaccgccgtacagaccacgattgatatgctgatagaagcgggatgccggaaatttgcattaaaagcaaagctggccggcggatcagagatgtttaaatttaaatcgacaaatgatttgatgaagatcggaccgagaaatgtattagcgataaaagaacagctgtctttatttaatattcctattattagtgaagatacgggcggctcaagcggccggacgatagaatttgaaccgaagtcctgcatgctgcatattcgaactgttaaacaaggtgaaaaaacgatttaattaaggtattagggggataacaatgcaatccttgaattatgaagatcaggtgctttggacgcgctggaaagagtggaaagatcctaaagccggtgacgacttaatgcgccgttacatgccgcttgtcacatatcatgtaggcagaatttctgtcgggctgccgaaatcagtgcataaagacgatcttatgagccttggtatgcttggtttatatgatgcccttgaaaaatttgaccccagccgggacttaaaatttgatacctacgcctcgtttagaattcgcggcgcaatcatagacgggcttcgtaaagaagattggctgcccagaacctcgcgcgaaaaaacaaaaaaggttgaagcagcaattgaaaagcttgaacagcggtatcttcggaatgtatcgcccgcggaaattgcagaggaactcggaatgacggtacaggatgtcgtgtcaacaatgaatgaaggtttttttgcaaatctgctgtcaattgatgaaaagctccatgatcaagatgatggggaaaacattcaagtcatgatcagagatgacaaaaatgttccgcctgaagaaaagattatgaaggatgaactgattgcacagcttgcggaaaaaattcacgaactctctgaaaaagaacagctggttgtgagtttgttctacaaagaggagttgacactgacagaaatcggacaagtattaaatctttctacgtcccgcatatctcagatccattcaaaggcattatttaaattaaagaatctgctggaaaaagtgatacaataatgaatttcatggttagcgagtgaaaaacatgtcaacactattatggcttttaagctttacgctccacggcgttcttctgtacgctgtcattatcctgtatacgaggctcgctgcagtgaaagaaacagaaaaacagcaaaaacagatacttgaagagacggaaaacaccttggcggcatttctgcttgaattaaaagaagaaaatgagaaactgatagaaaataaagcttcatctgcaagtcaatcagatgaagaatcccaaaaaccaggcattcagcactctgaaacatatcaagagcgggatccagtccaagaggcagagaatcttcctgaacatattgaaggtctgattacagaggttgaccgtcgggaagagatcgtaaacagtgaggtccaatcatttgaagaccaggtcatagaattatatgaacagggatattcggcaagtcaaattgcccagaaaatgaagagcggaaagacagaaatcgagctatttttaaaatttcgctccaaaggtgtaaaggattcttgattgtcggataaagctgtgttatattaggtcttggtgttaaatacacacgcttaacgatttatgcagagggtgctgcaggcggcagttctgcacaaaaatgacctaagcggaggaaaaaaaccattatattaggaggaaataacatgtcagtcatttctatgaagcaattgcttgaagctggtgttcacttcggtcaccaaacacgccgctggaacccaaaaatgaagcgttacattttcacggagcgtaacggaatctacatcattgaccttcaaaaaacagtcaaaaaagtagaggaagcttacaacttcactaaaaatcttgctgctgaaggcggaaaaatccttttcgtcggaacaaaaaaacaagctcaagattctgttaaagaagaagctcaacgctctggcatgtactatgtcaaccaacgctggttgggcggtacattaacaaacttcgaaacaatccaaaaacgtattaaacgtcttaaagacattgaaaaaatgcaagaaaacggtacgtttgatgtacttcctaaaaaagaagtcgttcaattgaaaaaagaattagagcgtcttgaaaaattcctaggcggaattaaagatatgaaggatcttcctgatgcattattcatcatcgatcctcgcaaagagcgcatcgctgttgcggaagctcgcaaattaaacatccctatcatcggtatcgtagatactaactgtgatccagatgaaatcgatgttgttatcccagcgaacgatgacgctatccgcgctgttaaacttctaacttctaaaatggcagatgcaatcttagaagcgaagcaaggcgaagaagaagcggaagttgctgaagaaactgcaccagaaacagaaacaacaactgcgtaacctattcaaaaggtgataagagggactgccttttatcaccttttttcaagaaaaatgtgtaatatacatactcttgtttaaacatataaggaggaatacaaatggcaattactgcacagcaagtaaaagaactgcgtgaaaaaactggcgcgggcatgatggattgtaaaaaagcgttaactgaaactgacggagatatggacaaagcaattgaccttttaagagaaaaagggattgcaaaagcagcgaaaaaagctgaccgtatcgcagcagaaggttctactcttattaaaactgacggcaacaaaggcgttatcctagaagtaaactctgaaactgatttcgttgcgaaaaacgaaggcttcaaagagcttcttaacactttagctgaccaccttcttgcaaacacgccagctgatgttgaagaagcaatgggccaaaaaatggaaaatggctcaactgttgaagagtacatcacaagcgcagttgctaaaatcggtgagaaaatcactcttcgccgctttacagttcttacaaaagacgacagctctgcattcggtgcgtaccttcacatgggcggccgcatcggtgtattaactgttctcaacggtacaactgatgaagaaactgcgaaagatatcgcaatgcacgttgctgcggttaaccctcgttacatttctcgtgatcaagtatctgaagaagaaacaaatcatgagcgtcaaatcttaactcagcaagccctccaagaaggcaaacctgaaaacatcgtagcgaaaatggttgaaggccgtctgaacaaattcttcgaagaaatttgtctattagaccaagcgttcgttaaaaacccagatgaaaaagtgaaacaagttattgcagcgaaaaacgctactgttcaaacttttgtccgctatgaagttggagaaggcatcgaaaaacgtcaagaaaactttgctgaagaagtaatgaaccaagtgaaaaaataatggtgaaaagatttcgcggctaagtcgcgtcttttcaggcagtataggggacacattttgtgttccctatttttaaaactatatttacaaacctttttttctcttgcataatagaaaacggcaatgtttacacttggaggttatcatggaaaaaccaaaatacaaacgtatcgtattaaagcttagcggggaagcattggcaggagaacagggaaatggaattaacccgactgtcattcaatccattgcaaagcaagtgaaggaaatcgctgagcttgaagtcgaagtggctgttgtagtaggcggcggcaacttatggcgcggaaaaacaggaagtgacctgggcatggaccgcgcgactgctgactatatgggaatgctggcgacagtaatgaattcgcttgctcttcaagacagcttggaaacactcggaatccagtccagagtgcaaacatccattgaaatgagacaagttgctgaaccgtacataagaagaaaagcgatacgccacttagagaaaaaacgtgtcgttattttcgctgcgggcacaggaaacccatatttctcaactgatacgacagctgcactgcgggctgctgaaattgaggcagacgttattttgatggctaaaaataacgttgacggtgtgtataatgctgatcctagaaaagatgaatcagctgttaagtatgaatcactttcttatcttgacgttcttaaagacggcctggaagtcatggattcaacagcttcctctttatgcatggacaatgacattccgcttatcgtcttttctattatggaagaaggaaatatcaaacgtgccgttatcggtgaatcaatcggaacgatcgtgagggggaaataacgtgtcaaaagaagtattaactcaaacaaaagaaaaaatggaaaaagcaattgctgcttatcagcgcgaattggctactgtacgcgcaggccgtgcaaatccatcattattagataaagtaacggttgaatattacggagcgcagacacctttaaatcagttgtcttctattaacgtgcctgaagctcgtatgctcgttatcacaccatacgacaaaacagcaattggcgatatcgaaaaagcgattttaaaagctgatttaggtcttacaccaacaagtgacggcaatatgattcgaattgcaattccggcactaacagaagagagacggaaagaattagtgaaagttgtaaaaaaatacgctgaagaagcaaaagtcgctgttcgtaacgttcgccgtgatgctaacgatgatctcaaaaaacttgagaaaaacggagacattactgaggatgaactgcgtgcttccactgaagacgttcaaaaactgacagatgaatatgtgtcaaaaattgacagtgtcacaaaagacaaagaaaaagaaatcatggaagtttaatgaaaaactatgtacaatagataatagtgaaaagaccctctcatgtttacagggggtttttttgttaatactgttgattacattgattatcagcagggaatgtaacctttttgggtgacggaggaatctcatgctcaacatactcaaaaattggaagaatcagcaaactgcggcttccaacttagaacgttatacaaaagaagacatacttaagggagaaattcccgaacacatcgccattatcatggatggaaatggccgttgggctaaaaaacgctctcttcccagaattgcaggccaccatgaagggatgaaggtggtaaaaaggaccacgaagctcgcaaacgaattaggtgtcaaagtactgacattgtatgcattttcaacagaaaactggaaaagaccgaaaatggaagtcgattttttaatgaagcttccggaagaatttttgaatacgtatcttccagagcttgttgaggaaaatgtacaggttcggatcattggggatgaaacggctttgccggcgcacacattacgtgcgattgaaaaagctgtacaggacacggcgcaaaacgacggaatgatccttaattttgctcttaactatggaggccgtactgaaattgtcagtgctgcaaaatcactcgcggaaaaagtgaaggaaggctctttgaatattgaagacattgatgaatcgcttttttctacttatttgatgactgaatctttgcaggatcctgaacttttaattcgaacgagcggcgagataaggctgagtaattttatgctatggcaggttgcctacagtgaatttgtctttactgacgtcttgtggcctgactttaaagaagatcacttcttacaggcgttaggagagtttcagcagagaggccggaggtttggcggaatttagaggatggtggacatgaaacaaagaattttgacaggtgttctggcagcaattgtatttttatttttggttattgtcggggaattgccgttcaccatattaatttatgctatgggcagtgtggcgctttttgaacttttacggatgaaaaagctgaagctggtttcactgccgggtttgatcggtcttttattgttgtggatgttcttattgccaagccagtattcgttttttgaagcggacggaatttccaaaatggaaatcgctttatttgcggtactgctattgctgacttacacagtgttggtcaagaacacctttacttttgatgaagtcgggtttattacgcttgcagcaatttacatcggaatgtgttttcattattttatcgaaatcagaaatcttgaccaatacggattaacatacattttttatgcgtgtgttgtcatttggtccacggattccggtgcctattttgtcggtaaatcgcttgggaagcggaaactgtggcctgaaatcagtccgaataaaacagtggaagggtttgcaggcggaattgtcatcgcacttgtattggcgacgatttttcagcttgttgcacaacttccgatcccgtatatctatctgctgttgatcacgctgtttttgtctgttttcggacaactgggagatttagtggaatccgccttgaaaagacattacgatgtaaaggattctgggaatattcttcccgggcatggcggtatattagaccgttttgacagtttcttgtttgtcatgcctttcttgtactttctgcttgcccttttttcataaaaaagtctaatatgaatatgagactgatcatgcagcaataagaataggagtagtggcaactttgaaaaatatttgtcttttaggagcaacaggatcaatcggcgaacagactcttgatgtactgcgtgcacatcaagaccaatttcagctggtatctatgtcgtttggcagaaatattgataaggccgttccaatgattgaggtctttcagccgaagtttgtctctgtcggtgatctggatacatatcataaattaaaacaaatgtctttttcttttgaatgccaaatcgggctgggagaagaaggactgatagaagcagcagtgatggaggaggttgacattgttgtcaacgctttgcttggaagcgtcggtcttatcccgacattaaaggcaattgaacagaaaaaaacaattgcgcttgcaaataaggaaactcttgtcactgcagggcatatagtaaaagaacatgctaagaaatatgatgttccgctgctgcctgttgacagtgagcattcagccatttttcaagctcttcaaggcgaacaggctaaaaacattgaacgcctcatcattacggcatccggcggaagttttcgggacaagacgcgggaggagctcgaatcagtaacagttgaagatgcattaaaacatccaaactggtcaatgggtgcaaaaattacaattgattcggctacaatgatgaataagggattagaggtgatcgaggcacactggcttttcgatataccttatgaacaaattgatgtggttttacataaggagagcatcatccattcaatggttgagttccatgataaaagtgtgatcgcacagctcggaactccggatatgagagtccccattcaatatgcgctcacttatcctgaccgattgccattaccagatgcgaaaaggcttgaattatgggaaatcggcagccttcattttgagaaagctgattttgacaggttccgatgcttacaatttgcttttgaatcaggtaaaataggaggaacaatgccgacagtgctaaatgcggcaaacgaagtagctgtcgctgcctttttagctggcaagataccgtttttggctattgaagactgtatcgaaaaggcactaacccgccatcaattactgaaaaaaccgagcctggcggacattcaagaagtggacaaagatacccggggatacgtcaattcaatactcacataaggtggtatgttcgtgaatacagttatagcgtttatcattattttcggaacgctcgttttcttccatgaactgggccatttattgctagcccaaagagcgggaattctctgccgtgaatttgcgatcggcttcggtccaaagattttttctttcaaaaaaaatgaaacagtttatacgatcaggctgcttccggtcggcggatttgttcgtatggccggcgaagatccggaaatgattgaggtgaaacccggatacacggtcgggcttctgtttaataaggaagatcaagttgagaaagtcatcatcaatcaaaaggaaaaatatccggatgcattagtcattgaagtggaaacagcggatctagagcatgacatgaagatcaccggttatgaacaggggaaagaggacgaactttccagctttactgtcagcgaaacatccttttttattgtagacggagaagaagtgcagattgcgccgtataatcgccaatttggttccaaacctgtatggcagcggattaaagcaattgctgcagggccgattatgaactttattttagcttacgtcattttagtgatgcttgggctgattcaaggcgtaccgtcaaatgaacctatgctcgggcagctgacagacaatggacgggcggctgaagcagggctaaaagaaggggattatatccaaagcattaacggagagaaaatgaggtcttggactgacattgtctccgctgtaaaagaaaacccggagaaagaaatggacgttgcggtaaaaagagataacaaaacgcttcatatttcggtgactccggaagctgttaaagatgagaacaaaaaaacaatcggacgtttcggttcctatgcgccgactgaaaaaggcgtactctcagcggttgcttacggcgcgacatcaacagttgatgtcaccaaagccattttaaccaatctgagcaaattagtaacaggccaatttaaactcgatatgctgtcaggtcctgtcggcatatatgacatgacagaccaagtggcgaaaacagggatcgtgaatttatttcagtttgcggcgtttttaagcattaatcttgggattgtcaacctgcttccgattccggcacttgacggaggaagactgttgtttctatttattgaagcgattcggggcaaaccgattaacagggaaaaagaagcatttgttgtgtttatcggagtagctttcttaatgcttcttatgctggttgtcacatggaacgatatccagcggctgtttttgtaaacgaaaagtaaatcaatcagaggtgcgaagaaatgagacaaagcttgacgcttattcctacgctccgtgaagttccagctgatgccgaagcaaaaagtcatcagcttcttctgagagcaggatttatcagacagaatacgagcggggtatacagctatatgcctcttgcgtataaggtgattcaaaacattcagcagattgttcgagaggaaatggagaaaattgatgccgtagaaatgctcatgcccgcattgcagcaggcagagacatggcaggaatcaggcagatggtatacgtatggtcccgaactgatgagactaaaagaccgtcatggccgtgaatttgctttaggggcaacgcatgaagaggttattacttcgcttgttcgcgatgaggttaaatcttataagcgtctccctctgactctttatcaaattcagtctaagttcagagatgaaaaacgtcctcgcttcggtttgttaagaggccgcgaatttattatgaaggatgcgtactctttccatgcatctgcagagagcctagatgaaacgtatcaaaaaatgtacgaggcctattctaatatttttgcccgctgcggcattaatgtaagacctgttatcgctgattcaggcgcaatgggaggaaaggatacgcacgaatttatggcactttctgcgatcggagaggatacgattgcgtattctgatgaatcacagtacgcggctaatatcgagatggctgaagttcttcaccaggaagttccttcagatgaagagcctaaagctctagagaaggttcatacgcctaacgtgaaaacaatcgaagaactgactgcgttcttacaggtttcggctgaagcgtgcattaagtcagtattgtttaaagctgatgaccgttttgtcttagtgcttgtaagaggggatcatgaagttaacgatattaaagtgaaaaacttgcttcatgcagaagttgtagagcttgccacacatgaagaggtcattcagcagctcggaacagagccaggctttgtaggccctgttggtattcatcaggatgtggaagtatatgccgatcaagctgtgaaagcaatggttaatgctgttgccggggcaaatgaaggagatcatcattataaaaatgtcaatgtgaatcgtgacgcgcaaattaaagaatttgctgatcttcgttttattaaagaaggtgatccttcaccagacggcaagggaacgatccgttttgctgagggaatcgaagtcggacaagtctttaagctcggaacacgctattcagaagcgatgaatgcgacgtatttagatgaaaacggacgcgcgcagccaatgctgatgggctgttacggaatcggtgtgtcaagaacgctttctgctattgctgaacagcatcacgacgaaaaaggattaatatggccaaaaagcgttgccccgtacgatcttcatattcttgcattgaacatgaaaaacgatgggcaaagagagcttgctgaaaagctgtatgccgatttaaaagcggaaggctatgaagtgctctatgacgaccgtgctgagcgtgccggtgtaaaattcgctgattcagatctaatcggccttccaatccgcatcactgtcggaaaacgggctgacgaaggaatcgtcgaagtgaaaattcgtcaaactggtgagtcaactgagatttcagtagacgaattatctgcgtttatcagcaagcagtaatcaccataacgatttatcaaaaaacatgttaaaatagaaataatagaaggtacctcattgcctgaggtaccttcacttatgatgtttttagggagggatactgtcttaatggaacagttatcagtaaacagaaggcagtttcaaattcttctgcagcagattaatatgacagatgataccttcatgacatactttgaacatggcgagattaaaaagctgacaattcacaaagcttctaaatcttggcattttcattttcaatttaaatctttgctgccttttcaaatatatgacacattaacaacgaggctgacgcaatcgtttgcccacatagcaaaagtgacatcttcaattgaagttcaggatgccgatgtcagtgaaagtatcgttcaagactactggtcacgctgcattgaagaactgcagggcatttcgccgccgattattagtcttttaaaccagcaaaaaccgaagctgaagggcaataaactgattgtcaaaaccaaaacggatacagaagcggctgcgctaaagaacaaatacagttccatgatacaagcaggctaccgtcaatttggctttccagatcttcagcttgatgctgaaatatttgtatccgagcaggaagttcaaaagtttcgggagcaaaagcttgcagaagaccaagagcgggctatgcaggccttgattgaaatggagaagaaagataaagaaagtgatgaagaccaagcaccatctggtcctcttgttatcggttatcaaattaaagataacgaggaaatccggacacttgacagcatcatggacgaagaacgaagaattacggtccaaggttatgtgtttgatgtggagacgcgcgagctgaaaagcgggcgcacgctgtgtatcttcaaaattacagactatacaaatagtattttgatcaaaatgtttgcacgtgaaaaagaagatgcggcactgatgaagtctctgaaaaaaggaatgtgggtaaaagcacgcggaagcattcaaaatgatacatttgtcagagaccttgtcatgatcgcaaatgacgtaaacgaaataaaagcaaaaacccgtgaagattcagcacctgaaggagaaaaaagagtggaattgcatcttcattccccaatgagccaaatggatgctgttacgggtatcggaaagcttgtcgaacaggcgaaaaaatgggggcatgaggccatcgctttgactgaccatgctgtcgttcaatccttccctgatgcgtattctgcggccaaaaagcatggaattaaaatgatttacgggatggaagcgaatctcgtggatgatggcgtgccaattgcttataatgccgcacatcgtctgcttgaagaagaaacatatgttgtttttgacgttgagacgacaggattgtctgctgtatacgataccattattgagctggctgcagtaaaagtaaaaggcggagaaattattgataaatttgaggcgtttgcgaacccgcatcgtccgctttccgccacaatcatagagctgacagggatcactgatgatatgctacaagacgctccggatgtcgtagatgtaataagagatttcagagaatggattggcgatgatatccttgtcgctcataatgcaagctttgatatgggattcttaaatgtagcctataaaaagcttcttgaagtcgaaaaagctaaaaacccagtcattgatacgcttgaacttggtcgttttctctatccggaatttaagaaccaccggttgaacacactttgtaaaaagtttgatatcgaactcacacagcatcaccgtgcgatctatgatactgaggcaaccgcttatttgcttctgaaaatgctgaaagacgcagctgaaaaaggtattcagtaccatgatgagttgaatgaaaatatgggtcagtccaatgcttatcaaagatcaagaccgtatcatgcaacattacttgccgtgaacagcacgggacttaaaaatttatttaagcttgtgtcactttctcatattcattatttttacagagtgccgcgtattccgagatctcagcttgagaaatacagggaagggctactgatcggttctgcctgtgacaggggagaggtttttgagggaatgatgcaaaaatcgcctgaagaggtggaagatatcgcgtcattctatgattaccttgaggttcagccgcctgaagtgtatcgtcacttgctggagcttgaactggtccgtgatgaaaaagcgctgaaagaaattattgcgaatatcacgaagctgggggaaaagcttaataaaccggttgttgctacgggaaatgttcattacttgaatgatgaggataaaatctacagaaagatcttaatatcctcacaaggcggggcaaatccgctgaataggcatgaactgccgaaagtgcatttcagaacgacagacgaaatgcttgaagctttttctttcttaggtgaagaaaaagcgaaggagatcgtagtcaccaatacccaaaaggttgcttctttagttgatgacatcaagccgattaaagatgatttatatacgccgaaaatcgaaggcgctgatgaagagatcagagaaatgagctatcagcgtgcaagaagcatttacggggaagagctgcctgaaattgtcgaagcgcggattgaaaaagagttaaagagtattattggccacggatttgctgttatttacttgatctctcacaaacttgtaaaacgttcactagatgacgggtatctcgttggttcccgtggttccgtaggatcttcattagttgcgacacttactgagattactgaggtaaacccgctgccgccgcactatgtttgtcctgagtgtcagcattctgagttctttaatgacggttctgtcggttctggttttgacctgcctgacaagacatgtcctcattgcggaacgcctttgaaaaaagacggccatgatattccatttgaaacgttcttaggatttaaaggggacaaagtacctgatatcgatttgaacttctcaggggaatatcagccgcaagcacacaattacacaaaagtattgttcggagaagacaatgtatatcgtgcgggaacaataggcacggtggcagaaaaaacagcctacggttatgtaaaaggctatgccggagacaacaatcttcatatgcgcggtgccgaaatagatcggctcgtacagggatgcacaggtgtaaaacgtacaactggacaacaccctggcggtattatcgtagttccggattatatggatatttatgatttttcaccgatccagttcccggcagatgccacaggttcagagtggaaaacgactcattttgacttccactccatccatgacaatctgttaaaacttgatattcttggacacgatgacccgactgttattcggatgcttcaagacttaagcggaatagatccgaaaacaattccgacggatgatcctgaagtgatgaagatcttccagggaaccgaatcactcggtgtgactgaagaacagattggctgtaaaacgggcactcttggaattcctgaattcggaacccgatttgtccggcagatgcttgaagatacaaagccgaccactttttctgagctcgttcagatttcaggcttgtctcacggaactgatgtatggcttggcaatgcacaggagctcatccacaataatatttgtgagctgagtgaggttatcggctgccgtgatgacattatggtttatttaatctatcaaggccttgagccgtcccttgcctttaaaatcatggaattcgtgcgtaaaggaaaaggattaacgcctgaatgggaagaagaaatgaaaaataacaatgtcccagactggtatattgattcttgtaaaaagattaaatacatgttcccgaaagcccacgccgcggcatatgtcttaatggcagtccgcattgcttactttaaagtgcatcatgctcttttgtattatgcggcttattttaccgttcgtgcagatgactttgatatcgatacaatgatcaagggctctacagcaatcagagcggtaatggaggatataaacgctaaaggacttgatgcttcaccgaaggaaaagaaccttctgactgttttagaattagcgcttgagatgtgtgagagaggctattcattccaaaaagtcgatttatatcgctccagcgctacagagtttattattgacggcaacagtcttattccgccgtttaactctattccaggattagggacgaacgctgctttgaacattgtaaaagctcgcgaagaaggcgaattcctctcaaaagaagatttgcaaaagagagggaaagtatcaaaaacgattttagagtacttagatcgccacggctgtctggaatcactgcctgatcaaaaccaattgtcactgttctaatatggaaagcagaatttctcagaaattctgcttctatgcatacataagcgcaaaaagtgccatcgtaatattagagtttctgtcacttgcttaggtatgaaggtaagcgtatatccatttgcaataaaaatatggttatggtatagttttattggaaatgctaacgattaccgaggcaaagagtggggaaacccgctcttttgtattgaacaggagaattttgtctcgacatgttcatcgtttactttttagcccctgctcttttgaagcagggtttttatgcagagtgacgagacgaatatgagatcgacagcacaaggaggaagaacatgagcaaaaaagtgactgacatcgttcaagaaatggctcagccaatcgtagacagccttcagctggaactcgttgacattgaatttgtcaaagagggccaaagctggttccttcgcgtgtttattgattccgatgacggtgtggatattgaggaatgtgccaaagtaagcgaagctttaagcgaaaagcttgatgaggcagacccaatcagccaaaattactttcttgaagtctcatctccaggagctgagcgtccgctaaagaaaaaagccgatttcgaaaaatcactaggaaaaaacgtatacattaagacgtatgagcctattgacggcgtaaaagtgtttgaaggtgaactggctgaatttgatggacaaacagtgacagttgagatcacgatcaaaacaagaaagaaacggatcaatattccgtatgaaaagatagctaatgcaagattagctgttacattctaatgaatacaaatgttttaaggggggagaccgttaaatgagcagtgaattattagatgctctcacgattcttgaaaaagaaaaaggcatcagtaaagaaattatcatcgaagcaatcgaagctgcgttaatttctgcttataagcggaattttaatcaagcgcaaaatgtacgggtggatctaaaccgtgaaactggctccatccgtgtatttgcaagaaaagatgtcgttgacgaagtatacgaccagagattagagatctcaattgaagaggcacagggcatccatccggaatatatggtcggcgatgtcgtcgaaatcgaagttacacctaaggatttcgggcgcatagctgctcaaacagcgaagcaggtcgtcacacagcgtgtgcgcgaagctgagcgcggtgtgatttattctgaatttatcgaccgtgaagaagacatcatgacagggatcgttcagcgtctggacaataaatttatctacgtgtctttaggcaaaatagaagccttgctgccggttaatgagcaaatgccgaatgaaagctacaagccccatgaccgcattaaggtatatatcacaaaagtagaaaaaacaacgaagggcccgcagatttatgtgtcaagaacacatccaggcctgttaaagcgtttgtttgaaattgaagtgcctgaaatttatgatggaactgtcgagctaaaatctgttgccagagaagccggcgaccgttcaaaaatttctgttcgcacagatgatcctgacgttgatcctgtcggttcatgcgtagggcctaaaggccagcgtgtgcaagcaatcgtcaatgaattaaaaggtgaaaaaattgacattgtcaactggtccagtgatcctgtagaatttgtcgcgaatgcgctcagcccttccaaagtgcttgatgtcattgttaatgaagaagaaaaagcgacaactgttattgttcctgattaccagctgtctctggcaattggcaaaagaggacaaaacgcacgcttagctgctaaactgacaggctggaagattgatattaagagcgaaacggacgcaagagaacttggaatctatccgagagaacttgaagaagatgatgagccgctctttacggagcctgaaactgctgaatcggatgaataagaggtgactttaggtgaataaacacaaaaagatcccattacgcaaatgtgtagtgactggtgaaatgaagcctaaaaaggaactgatccgagttgtacggtcgaaagaaggcgaaatctcagtagacccgaccggaaaaaagaatgggcggggtgcttatttaacgctggataaagaatgcatcttagcagcaaaaaagaaaaacactttgcaaaatcaatttcaatcacaaatcgatgaccagattttcgatgaattgctggaactggcggaaaaggtgaaaaaataaaatgtctggaatggaatggtttcccttgctgggtctggccaatcgagctcgtaaggtcgtgtcaggcgaagacttggtaataaaagaaatcaggaatgcgcgtgcaaagcttgtcctgcttacagaggatgcatcatctaacacagcaaaaaaagtaactgacaagtgcaattattataaagtcccttataaaaaagtcgagagtcgcgcggttcttggacgctctatcggtaaagaagcccgtgtcgttgtcgccgtcactgaccaaggttttgcgaataagctgatcagcttgctcgattaatatttttgggggtgaacgaatggctaaaatgagagtatacgaatatgcaaaagcgttaaatgtttcaagtaaggaaattttgaccgcactgaagaacatggatttagaagtgaataatcacatggccatgcttgaagaaaaggccattaaaaagcttgatgccaaatataaaaaaggcggcgcagctgctaaatctcaaaagccagcagaaacgaacaaaaacaaacagccacaaggggttaatcagcaatcagctggaaatcaaccaaataaaattcgagacggaaagaagaatgacgtgcagaataatcaatttaacaaaaacaagaagaataacaacaacaaaaaaaataaacgcaacaacaacaacaataaaaaccaacatcagcaaaagcctgtaaagccgaaaaaagagcttcctgagaaaattacattctctggcactttaacagttggcgcacttgctgaagagcttggcaaagagccttcagaactcattaaaaagctgatgcttcttggcgtaatggctaccattaaccaagagcttgataaagacacaatcgaactcattgcatcagaatatggtgttgaaacagaagaggtcattgtgcttgaagaaacagagctggaaaaatacgaagagcctgataatgaagaggatcttgaaattcgtcctcctgtcgtgacaatcatgggccacgttgaccatgggaaaacaacgcttcttgacagcatccgtaaaacaaaggttgttgaaggagaagcaggcggaatcactcaacatatcggcgcttatcaaattgaagagaacggcaagaaaatcacgttcttggatacaccgggccacgccgcatttacaacaatgcgtgcacgcggtgcagaagtaactgatattacgattcttgtcgtagctgccgatgacggtgtcatgccgcaaacagttgaagcgattaaccatgcaaaagcagcagaggttccaatcatcgtagctgtgaataaaatagataaagaatccgcaaaccctgaccgtgtgatgcaagaactgacggaatacggacttgtccctgaagcttggggcggagaaaccatttttgtgccgctttctgctttaactggaaaaggcattgatgagctcgttgaaatgattttgcttgtcagtgaggtagaggaactgaaagcgaatccgaaccgtcaggcaaaaggaacggttattgaagctgaactcgataaaggcagagggtcagttgcgacgttgctcgtacagactggaacactgcatgtcggtgatccgatcgtagtcggcaatacatttggccgtgtccgtgcaatggtcaacgacattggccgccgtgtgaaaactgccggcccgtcaactccggttgaaattaccggtttgaatgatgtccctcaagcgggagaccaattccttgtctttaaggatgaaaaaacagctcgttctgtcggtgaagcccgtgcttcgaaacagcttgaagagcagcgcagcgataaagcgaagctcagtcttgatgacttattcgagcaaattaagcaaggtgatgtaaaagacatcaacctcatcgtaaaagctgacgttcaaggatctgctgaagctttaacggctgcacttcaaaaaattgaagtagaaggcgttaaagtgaaaatcatccatacaggcgttggtgcgattactgaatcagacattatcttggcatctgcttccaatgcaattgttatcgggtttaatgtgagaccggacggaaatgctaagagtacggctgaagctgaaaatgtagatattcgacttcaccgtatcatttacaaagtaatcgacgagattgaagctgccatgaaaggtatgcttgatcctgaatatgaagaaaaagtaattggtcaagtagaagtacgccaaacattcaaagtatctaaaatcggtacaattgccggcggatatgttactgaaggaaccattacgcgcgacagcggcctccgtttaattcgtgacggcgtcgtcatctttgaaggcgaagtagatgttctgaaacgctttaaagacgatgtgaaagaagtttcacaaggctatgaatgtggtattacaattaagaaatacaatgacattcgtgaaggtgacatccttgaagcgtttgtcatgcaagaaattgaaagaacgtgatcggatttgcggagtgtgaatgcaccatttatgatgcaggatcgctaaaagaaaagcgtgccgttctgaagcgggttttaaccagggttcaaaacaagttcaatgtttcgatttcggagattggctatcaggacacctggcaaagaaccagcttcggaatcgccgctgtttcttcctctcgcgttcaaacagaaaaagaactgcaacgcgtcctagcgtttatcgattcttttcctgaaattgaacggacgatcactaggacagagtggttttaacttagaggtgattgaattgagtatgagagcaaaccgtgtcggcgagcaaatgaaaaaagaactcggtgatattatcagccgcaagctgaaagacccgagaattggttttctgacagtaacggatgtacgtgtatcaggtgatttgcaaattgcaaaggtgtatatctcggttctcggtgacgagaaaaaacgggaagaagcgctgaaagggctggcaaaagcgaaaggatttatccgatccgaaatcggcagccgcatcagacttcgaaaaacgcctgaaattgaatttgagttcgatgaatcaatcgattacgggaatcggatcgaaacactgattcacgaattacattcagagaaaccatctgaataaaaaaagagaggataggcgtatatcgtctgtcctctttcttcgtttataagaaaaaaactcaaaagaaggagtgaaaggcaaatggttaacggagttctccttttacataaacctgttggcatgacatcgcacgactgtgtcatgaagatccgaaagctgttaaaaacaaaaaaagtaggacatacaggaacgctcgatccggaagtatcaggcgtgcttccgatttgtgtaggaagagcgacaaaaatagtcgaatacttaactgaaaaatctaaaacgtatgatgcagaaataacattgggcttttcaaccacaacagaggatcaaaccggagaaacggtggaaacaaagcctgtcaatcacgacattgataaagcggatgtagaaaaggttttaaacagtttaaaggggaaacaagaacaaattccgcccatgtattccgctgtaaaagtaaacggcaaaaaattatacgaatacgcaagagcagggattgaagtagaacgtccgaaacgtatgataaccattgaagacattgccctgacaacagagattaaacatcatggagaaaccgcaagcttccggtttacagtgacttgctccaaagggacctatgtaaggacgctggcggtcatgatcggagaaaagctcggatatccggcccatatgtctcatttaatccgtacggcatccggagatttttctctcgacgaatgctttacttttgatgaactcgaagcacaggcccaatccggaaccgtggaagagcatacagttcctattgaacgtgcgctcaatcatttgccgaaatggatcataagtgatacattagctaagaaagtagaaaatggggctttgcttgagacgcccgagcagttttctgaaatgacaagtgaagaccgtattgccgtctttactgaatccggaacctgcttggcgatctatttccctcatcctgcaaaaaaagggctgttaaagccggcaaaagtattgatgcaaaaaagcgaacaatagaaaaaaggtgaccgttctgtgaagacgatacatattacacatcctcatcatttaataaaagaggagcaggcaaaatcagtgatggcgttaggttattttgacggcgttcatctcgggcatcaaaaggtaatcggcacagcgaagcaaatagccgaagaaaaaggtctgacattagctgtgatgacctttcatccccatccttctcacgtgttgggcagagataaggaaccaaaggatctgattacgcctcttgaagacaaaataaaccaaattgaacaattaggcacagaagttctgtatgtcgttaaatttaatgaagtgtttgcttctctttctcctaagcagtttatagaccagtatattatcggccttaatgtgcagcacgcagtggcaggctttgactttacgtacggcaaatacggcaagggaacaatgaagaccatgccggatgatttagacggaaaagctgggtgcacaatggtagaaaaattaacggagcaggataaaaaaatcagttcttcgtatatccgtaccgcgcttcaaaacggagatgttgaattggcgaatgtcttgcttggacaaccttattttattaaaggaattgtcattcatggtgataaaagagggcggaccatcgggtttccgacagcgaatgtcggtttaaataacagctatatcgttccgcccacaggtgtatatgccgtaaaagcggaagtgaacggcgaagtttacaatggcgtttgcaatattggctataagccgacgttttatgaaaagcgccctgagcagccttccatcgaggtcaatctgtttgatttcgatcaagaggtatatggagccgctataaaaatcgaatggtacaaacggattcggagcgagcggaaattcaatggtatcaaagaattaacagagcaaattgagaaagataagcaggaagccatccgttatttcagcaatttgcggaaataacttgcaacgcacgcaaattttattctaaaatatttgcatataggcacgatttttagtatgatagttttcgtagtcttaaaaccattgcttggcaatccgaagtcaccgacggttgctaggtaactggggctaaatatgatttggaggtgaaacaggatggcaattactcaagagcgtaaaaaccaactcatcaatgagttcaaaacacacgaatctgatactggatctccagaagttcagatcgctatcctaactgactcaattaacaacttgaacgagcatttacgtactcacaagaaagaccaccactcacgtcgcggtcttcttaaaatggtaggtaagcgtcgtaatcttcttacgtatctgcgtaataaagacgtaactcgttaccgtgagttaattaacaaactaggcttacgtcgataatcgtaaaaagcgggaggattcccgcttttttatcgtattaaagcgaaatttcttataacaaatcattgaaatccttttacatactactttgacattgatatgttcaattcatttcgttcataataggagtaattgattatttcacacaacgaagagaggagttcgtaattgtatgggacaagaaaaacatgtctttaccatagattgggccggaagaacgcttactgttgaaaccggccagcttgccaaacaggcaaatggtgctgtgatgatccgctacggtgatacagcagtacttagtacagcaaccgcttcaaaagaacctaaaccgcttgatttcttccctcttactgtaaactatgaagaaagattatatgcggtagggaaaattccgggcggatttattaaaagagaaggacgtccaagtgaaaaagcggttcttgccagccgtttaattgaccgtccgatccgtcctttgtttgccgatggattccgtaatgaagttcaagtcatcagcattgtcatgagtgttgaccaaaactgctcttcagaaatggctgccatgttcggttcatctcttgcactttctgtatcggatattccgtttgaaggaccgattgcaggggttactgtcggacgcattgatgatcaatttatcattaacccgacagtcgatcagcttgaaaaaagcgacatcaatcttgtcgttgccggcacgaaagatgcgattaacatggtagaagcgggagcggacgaagttcctgaggaaatcatgcttgaggccattatgttcggccatgaagagattaaacgcctgattgcattccaagaagaaattgttgcagcagtcggcaaagagaaatctgaaattaagctctttgaaattgatgaagagcttaatgaaaaagtaaaagctttggcagaagaggatctgctgaaagccatccaagttcatgaaaagcatgcccgtgaagatgccattaacgaagtgaagaacgcagttgtggcaaaattcgaggatgaagaacatgatgaagacacaatcaagcaagtgaagcagattttatccaagctggtgaaaaatgaagttcgccgcctgattactgaagagaaagtaagaccggatggccgcggtgtcgatcaaatccgcccgctctcttcagaggttggcctcttgccaagaacgcacggttcaggtctatttacaaggggacaaactcaggccctcagcgtatgtacgctaggtgctctgggagatgtgcagatccttgacggcttaggtgtcgaagagtcgaaacggtttatgcatcattacaacttcccgcaattcagcgttggggaaacaggaccgatgcgcggaccgggacgtcgtgaaatcggacacggagcactgggtgagcgtgcgcttgagccagttattccgtctgaaaaagacttcccttatactgtccgtcttgtttcagaagtgcttgaatcaaacggttctacatctcaagcaagcatttgcgcaagcacacttgcaatgatggatgctggtgtaccgattaaagcgccagttgctggtattgcgatgggtcttgtcaaatcaggcgaacattacactgtcttgactgacatccaaggcatggaagatgcgctcggagatatggactttaaagtagcgggaactgaaaaaggcgtaacggccctgcaaatggacattaaaattgaaggcctttccagagagattcttgaagaagcgcttcagcaggcgaaaaagggcagaatggaaatcctcaacagcatgcttgcaacattaagcgaatcaagaaaagagctttctcgatatgcgcctaagatcttaacaatgaccattaatcctgataaaatccgcgatgtcatcggaccaagcggaaaacaaatcaataagatcatcgaagaaaccggtgttaaaattgatattgagcaggacggcacaatctttatttcctctacagatgaaagcggcaaccaaaaagcgaaaaaaatcatcgaagaccttgttagagaggttgaagtcggccaactttacctaggtaaagtgaaacggattgaaaaattcggggctttcgttgaaattttcagcggaaaagacggtttggtgcacatttcagagcttgcgcttgaacgcgtagggaaagttgaagatgttgtaaaaatcggagacgagattcttgtcaaagtcactgaaattgataaacaaggacgagtgaatttatcccgcaaagcggtgctccgtgaagagaaagaaaaagaagaacaacaatcttaaaagaaaacataaaaggagcctgggagacccggcttctttattttgaagcttttcaaaagcaggcgggttctaccttgtccttctccttcataatttgaggtgaggggggacagaacatgtacaaaaaatttgtaccgtttgccgtttttttatttcttttttttgtctcatttgagatgatggaaaatccgcatgcacttgattatataggggcaatgaaaaaagatacggtgactgtcacggcgtcaaaagaccaattatatgaagaattgcttcaaaaagcgccggagtacgaagttaagccccagaatgcaagaattgataaagtatggaaaagcattccaggctacaatggattaaaggtcaatattgaacaatcatataaaaaaatgaaaaagcatggtgagtttcgggaaaaagatttggtgtacagtcaagtaaaaccaagtgttcatcttgagtcacttcagcctgagcctatttataaaggaaatcctgacaaaccgatggtggcttttttaatcaatgtggcatggggaaatgagtatttggaaaaaatgctccctattctgcaaaagcaccaggttaaagctacgttctttttagaaggcaattgggtgagaaacaatgaaaagctcgctaagaagattgcaaaagacggacatgaaatcggaaatcattcatacaatcatccggatatgagcaaactgactacaggaagaatttccgagcagctcgacaagactaatgaacaaatagaacaaacgatcggcgttaagccaaagtggttcgctccgccaagcggaagtttcagaaaagcggttatcgacattgcagcagagaaacagatgggaacagtcatgtggacagttgatacaatcgattggcaaaagccggctccgtctgtacttcagacgagagtgttaagcaagatacataatggtgccatgattttaatgcatccgactgaccctacggcggaaagtcttgaagcgctgattacacagataaaagacaaaggatatgcgcttggaacagtcactgaactaatggatgaaacaagactattgaagtaacagatgaaggcagcttgtctttgaataggaggaacaaatttgattaaacgatatacgtgtcaaaatggtgtaagaattgtgctggaaaataatccgacagtccgttctgttgcgatcggcgtatggatcggcacaggttcgagacatgaaacgccggagataaacggaatttctcactttttagagcacatgttctttaaagggacgagcacaaaatctgcacgcgagatagcagaatcttttgatcgtattggcggccaggtcaatgcgtttacttcaaaggaatatacctgctactatgcaaaggtgcttgacgagcatgcgaattacgcgctggacgtattagcagatatgttctttcattcaacgtttgatgaaaacgagctgaaaaaagagaaaaatgtagtatatgaagaaattaaaatgtatgaagatgcgccggacgacattgtacatgatttattgagcaaagccacttacggcaatcattctttaggctacccaattctaggcacggaagaaacgcttgcttcctttaacggtgactctctcagacaatacatgcatgattattatacgccggaccgagtggtgatttcggtagcgggcaatatatctgacagttttatcaaagatgtagaaaaatggttcgggtcatacgaggcgaaaggcaaagcgacaggccttgagaagcctgagttccacacggaaaaactgacgagaaaaaaagaaacagagcaggctcatttgtgccttggatttaaaggcttagaggttggccatgaacgtatttatgatttaatcgtcctcaacaatgtgctcggaggcagcatgagcagccggctgttccaagatgtgcgtgaagataaaggacttgcttattctgtttacagctatcacagctcatatgaggacagcggaatgctcactatttacggtggaacgggtgcaaatcagcttcagcagctgtcggaaacaattcaagaaacccttgccacattaaaacgtgacggcattacctcaaaagaactggaaaacagcaaagagcaaatgaagggaagcttaatgctgagcttagaaagcacaaacagcaaaatgagccgaaacggaaaaaatgaactgctgctcggcaaacataaaacattagatgaaatcatcaatgaattaaacgccgtgaacttagagcgtgttaacggccttgccagacaattgtttaccgaagactatgcattagcacttatcagcccttccggcaatatgccgtcttaaaaaggaaagcctgctccataatggagcaggcattttttaatccctttcatcatacatagtacaagggggtgacagacatgcggctcagtgaattatcaggaaaggaaattgtagacatcaaaagagctgaacggctcggagtgctcggccagaccgatttggaaatcaatgaacaggatggacagattacagcactcctcattcccacagttaagtggtttggtttgagaaagcaaggtcatgacattcgtgtcccatggcaccatattcaaaagatcggttcagatatgattatattagatgtacctgaggaaatgcctcctcgacaagagtaaatagcccaattgactgtgaagcgggctctaaagaaaacatctgaaacatcggctgccggagccgatgtttttttatatggaaaaagcgcatcttttatattcaccagtattttcttttgatcataagatgaaggggagcttaacaactagagatccagtatatacaaagaaggtgaacgtttagaatgttaaccggattgaaaattgcagttatcggcggtgacgcaagacagctcgaaattataagaaagctcactgaacagcaggctgacatctatcttgtcggttttgaccaattggatcacggttttaccggggcagtaaaatgcaatattgatgaaattccttttcagcaaatagacagcatcattcttccagtatccgcgacaacaggagaaggtgtcgtatcgactgtattttctaatgaagaagttgtgttaaaacaggaccatctcgacagaacgcctgcacattgtgtcattttctcaggaatttctaacgcctatttagaaaacattgcagctcaggcaaaaagaaaacttgttaaactgtttgagcgggatgacattgcgatatacaactctattccgactgtagaaggaacgatcatgctggctattcagcacacggattatacgatacacggatcacaggtggccgttctcggtctggggcgcaccgggatgacgattgcccgtacatttgccgcgctcggggcgaatgtaaaagtgggggcaagaagttcagcgcatctggcacgtatcactgaaatggggctcgttccttttcataccgatgagctgaaagagcatgtaaaagatatagatatttgcattaataccataccgagtatgattttaaatcaaacggtactttctagcatgacaccaaaaaccttaatattggatctggcctcacgtcccgggggaacggattttaaatatgccgagaaacaagggattaaagcacttcttgctcccgggcttccagggattgtcgctcctaaaacagctgggcaaatccttgcaaacgtcttgagcaagcttttggctgaaatacaagctgaggaggggaaataaggatgtcgtcattaaaaggaaaaagaatcgggtttgggctgaccgggtcgcattgcacatatgaagcggttttcccgcaaattgaggcgttggtcaatgaaggagctgaagtccgtccggttgtcacatttaatgtaaaatccacaaatacccgatttggagagggcgcagaatgggttaaaaaaattgaagacctgactggatatgaggccattgattcgattgtaaaggcagaacctcttgggccgaagctgccccttgactgcatggtcattgcgcctttaacaggcaattcaatgagcaagctggcaaatgccatgacggacagcccggtgctgatggcggcaaaagcgacaatccgaaacaatcggcctgtcgttctgggtatctcgacaaatgatgctcttggtttaaacggaacaaatttaatgaggctcatgtcaacaaaaaatatcttttttattccattcgggcaagacgatccctttaaaaaaccgaattcaatggtagccaaaatggatctgctaccgcaaacgattgaaaaggcactcatgcaccagcagcttcagccgattctagttgagaattatcagggaaatgactaaatttacagaaaatctttcccaaactaaaaaattcggtcatcacccgcatattctatggtaaaataaaacgtaaaatcatagtcaaatcaattcaatgaagctgattggcggaaggagttttacagatgggaagaggtttacacgtagctgttgtcggagcgacaggggctgtgggacaacaaatgcttaaaacacttgaagacagaaactttgaaatggacacacttacattgctatcttcaaaacgctctgcggggacaaaagtcacgtttaaaggccgagagctgactgttcaggaagcttctcctgagagctttgaaggggtaaatattgctttgttcagcgccggcggaagcgtatcacaagcattggcaccagaagctgtaaaacgcggcgctattgttatagataatacgagcgcgttccgcatggatgaaaatacaccgcttgttgtgccagaagtgaatgaggcagacttgcatgaacacaatggcattattgccaatccaaactgctctacaatccaaatggttgcggcacttgaaccgatccgcaaagcatatggcttaaacaaagtcatcgtatcaacttaccaggcagtatcaggagcgggtaatgaagctgtaaaagagctttacagccaaacacaggcgattttaaataaagaagaaatagagcctgagatcatgcctgtaaaaggtgacaaaaaacactatcaaatcgccttcaacgcgattccgcaaatcgataaattccaagataacggctatacgtttgaggaaatgaaaatgataaatgaaacgaaaaaaatcatgcacatgcctgaccttcaagttgcggctacatgtgtgagactgccaatccaaactgggcactcagagtccgtctacattgaggtagaccgtgatgacgctacagttgaagatattaaaaatctattgaaagaagctccgggcgtgacacttcaggatgatccaagccagcagctttatccgatgcctgctgatgctgtcggcaaaaacgatgtgtttgtgggccgcatccgcaaagacttggacagagcaaacggttttcatttatgggttgtttctgataacctattaaaaggcgcggcatggaactctgttcaaattgcagaaagcctgaaaaaactaaacctcgtataaaagagagaattttctaaagacgaatagaagagagtaaggcgctatcagcctgctctcttctgttacgtccgaataatttggagtgaaaacagtgaagataattgttcaaaagttcggcggaacatcagtaaaaaatgataaaggccgcaaactggctttagggcatattaaagaagcaatcagtgaaggatataaggttgtcgttgtcgtttcagcgatgggccgaaaaggagacccgtatgcaacagattctttgctcgggctgctttacggcgatcagtcagcgatttctcctagggaacaggatttgcttttatcttgcggagagactatttcctctgtcgtctttacaagcatgctgcttgataacggtgtgaaagcagctgcgctgacaggggctcaggctggctttttaacgaatgatcagcatacaaatgcaaaaatcattgaaatgaaaccggagcgtttattcagtgtgctcgccaatcatgatgcggtagtcgtcgcaggcttccagggcgcaactgaaaagggtgatacaacaacaatcggcagagggggcagcgatacgtctgcagccgcactcggagcagctgttgatgcggaatacatcgatattttcaccgatgtagaaggcgtgatgactgctgacccaagagtggtggaaaatgcaaaaccgcttcctgttgtgacgtatacagaaatctgcaacctggcgtatcagggggccaaggtcattcatccgcgtgcggtggaaatcgcaatgcaggccaaggttccgatccgcgtccgttcgacttattcgaatgataaaggtacattggtgacatcacatcactcttccaaggtcggcagtgatgtttttgaaaggctgattacgggaatcgcccatgtcaaagatgtcacgcagttcaaagtgcctgcgaaaatcggccagtataacgttcagactgaagtgttcaaggctatggcaaacgctggaatcagtgtcgatttctttaacattacacctagtgaaatcgtctatacggtagccggaaataaaacagaaacagctcagcgtattttaatggatatgggctatgatccaatggtgacgagaaactgcgcgaaggtatcggcggtcggcgcgggcattatgggtgttcccggtgttacgtccaaaattgtatcggctctttcagaaaaagaaattccgatccttcagtcggctgacagccatacgacgatatgggtgctcgtccatgaagcggatatggttcctgctgtaaacgctttgcatgaagtgtttgaactttcgaagtaaatgtgattgaatcatgatgaggtgaataaaatgaatttcggaaatgtgtctacagcgatgattacaccctttgacaataaagcgaacgtagactttcaaaaactgtctacactgattgattacttgttgaaaaacggaacggattctttagtagtagcgggaacaactggagaatctccgaccctttcaactgaagaaaaaattgcgctttttgaatatacggtaaaagaagtaaacggacgggtgcccgttatcgctggtactggaagcaacaacacgaaagattccattaagctgacaaaaaaagctgaggaagcgggcgtggacgctgttatgcttgttaccccgtattacaataaaccttctcaagaaggaatgtaccagcattttaaagcaattgcggcagagacatctcttccggttatgctctataatgttcctggccgtacggttgcttctcttgctcctgaaacgacgatccgtttggcggcggacattccgaatgtggttgcgattaaagaagcgagcggagacctagaagcgattacaaaaattattgctgaaacaccggaagacttctatgtctattcaggggatgacgctctgacgcttcctattctttcagttggaggaagaggagttgtatcagtggcgagccatattgcaggctctgatatgcagcaaatgatcaaaaattatacgaatgggcaaacagctaatgcggcactgatccatcagaaactgctgccgattatgaaggaactgtttaaagcgcctaatcctgctccagtcaaaacagcgcttcagctgagaggtcttgatgtcggttctgtgcgtctgcctctagtcccgttaactgaggatgaacgtctgagcttaagcagcacgatcagcgaactgtaagaaaatttcatacagtgaaacaaacgcggtcattctcacatccagctgagtttgaccgtttcttttacatattggttttccctaaaccttctgctttatcttgttttctaaatttactttcagttataataggaacaagtgatgatggacgggtatgagactaggaggatatagattttgaaaaagaaaaatacagaaaacgttagaattatcgcccttggcggtgtcggagagattgggaagaacctttatgtcattgaaattgactcagacatatttgtcgttgatgccggccttatgcatccagaaaacgaaatgctcggtattgatgtagtgattcctgacatatcatatttgattgaacgggctgaccgcgtcaaggcaatctttttaacgcacgggcacgatgaaaatatcggcggcgttttttacttattaaacaagctgtccgttccagtgtacggaacaaaactgacgcttgcactgttaagagagaaattaaaacaatacggacataaccgaaaaactgatttaagagaaattcactcaaaatctgtcattacatttgaatcaacaaaagtatcgttctttagaacgattcacagcattcctgattctgtaggtgtgagctttaaaacatcacttggatctattgtatgcacgggagacttcaaatttgaccaaacacctgcacttaatcagacgtgcgacattggcgagatcgccaagatcggtaatagcggcgtgctcgctctgctttctgacagtgcaaatgcggaacggccgggttacaccccttcggaagcggctgtcagcggagaaatttcggatgcgctgtataattcacagaaccgggtgattattgcagtattcgcatccaatattaaccggattcagcaagtcattcatgcagcggctcaaaatggcagaaagattgccgtagccggaaaaaatcttcaatctgtcctgcagctggcgagaaagttaggatacattgaagcagatgatgaattgtttatttctgtacaggatgtcaaaaaatatccgaagcgcgaagtggccattattacagccggaagccaaggtgaaccattagctgctttgacaagaatggcaaacaaagctcacaaacagctgaacattgaagaaggggatacggtggtcattgcgtcaactccgattcccgggcaggaactcatttactctaaaacagtagatcttcttgcgagagccggtgcacaagtcatctttgcccaaaagcgtgttcatgtatcaggccacggctcacaagaagagttaaagctgatgatcaacctgcttaaaccaaaatatttgattcctgtaaacggcgaatacagaatgcaaaaagctcattcaaaaatcgctgaagaaaccggcatgaagcgcagtgacatcttcttaattgaaaaaggagacgtcgttgaattccgcggccaaaacgtaaaaattggggataaagttccttacggcaatattttaattgatggtttaggtgtcggtgatatcggcaatatcgtattgagagaccgccgcttgctttcacaggacggaattttaatcgttgtcattacacttgataaacaaaagaaacatcttgtatcaggaccagaaattatcactcgcggctttgtttatgtaagagagtctgaaggtctaatcgtacaggctactgagctcgtccggtccatcgtgacagaagcgactgaaacatcaaatgtcgaatggtcaacgctgaagcaggcaatgcgggatgctttgaaccaattcctttatgaaaaaacgaaacgtaaaccgatgatcatcccaattattatggaagtataatgactgactaaagaccggagctgctccggtctttattttttgtccttcaagccgggattgaatgaagtatctttgttcataatacaaagagaaactcggaaaggatgaaagcgagatggatcatcgtatggaaaacacagaagaagagcgtcctgaaaaaaatgatgcgaaggacagcatcatgaataaaatacagcagcttggtgaaacgacgcttccgcagctgccccaagatacaaatattcattgtctgaccattatcggacaaattgaaggccatgttcagcttcctccgcaaaacaaaacaacaaaatatgaacatgtcatcccgcagattgtggcaattgaacaaaatcccaaaattgaaggcttgctgatcatattaaatactgtcggaggagatgttgaagctggtcttgcaatagcggaaatgcttgcatctttatcgaaaccgaccgtttctatcgtgcttggcggggggcattccatcggcgttccgattgctgtatcctgtgattacagctatatcgccgaaacagcaacgatgacgattcatccagttaggctcaccgggctggtcatcggggtgccgcaaacgtttgaatacctggataagatgcaagaaagagttgttaaatttgtgacaagccattccaatataaccgaagagaaatttaaagagctaatgttttcaaaaggaaacttaacacgggatatcggaacaaatgtagtcggtaaggatgcagttaaatacggattgatcgatcacgcaggcggtgtcggacaggcaatcaataaactgaatgagctcatcgacgaagcaaggaaagaagaaggacggatgattcaatgattctttataccgtgatgccgcaggaaattgtgtttgcagaacagaaccaagagacaagcgcacatgagcaaattgaatataaaggtgtaccgcttctagtcgaaatgaaagggaatgaagcggaagtcattcaaatcatgagcaccaatccaatgcattttctgcatccggacatttcacccggacaaaagctgaaattaaacgtataagaatccaacccttttttaagggcaaaatatgctataataggggaatcctacagaaaaaacgcagcctgtaaacggctgctttcttcattatgtatgaacttacattttttaacgcagtaaggtgatgagtgtggcaaagaaaaaacgaaaatcaagaaaaaaacaggcgaaacagctaaatataaaatacgagcttaacggattgctgtgtatagccatttcaattatcgcaatcttgcagctgggggtagttgggcaaacgtttatctatttgttccgcttttttgctggagagtggtttattttatgcttgttaggtttattggtgttaggagtctcactgttttggaagaaaaaaaccccaagccttttaacgagacgaaaggccgggttgtactgtatcatcgcaagcatattgctgctttctcacgtgcagctatttaaaaatttgacgcacaaagggtctattgagtctgcaagcgtggtgcgcaatacgtgggaattgtttttaatggacatgaatggcagctctgcttcacctgatttaggcggagggatgatcggtgcgctgctgtttgcggcttcacactttttgtttgcgtcgactggttctcagatcatggcgattgtcatgattttgatcggaatgattttagtaacaggacgctcgctacaagaaacgctaaaaaagtggatgagcccgattggacgttttataaaagaacaatggttagcatttattgatgatatgaaatccttcaaatcaaatatgcagtcatcgaaaaaaacgaaagcgccgagcaaaaaacaaaaaccggcccgcaaaaaacagcaaatggaaccggagcctcctgatgaagagggggattatgaaacagtatcgcctcttattcattcagagccgattatctcaagcttttctgatcgtaatgaagaggaagagtctccagttatagaaaagcgccccgaacctgtgtcgaagccgcttcaggacatccaaccggagacaggtgatcaggaaactgtttctgctcctcctatgacctttacagagctcgaaaataaggattacgagatgccgtcactggatttgctggcagatccgaagcataccggccagcaggctgataaaaagaatatttatgaaaatgccagaaagcttgaacgcacattccaaagctttggcgtaaaggcgaaagtcacacaggttcatctcggaccggccgtaacaaaatatgaagtatatcctgatgtcggagtgaaggttagcaaaattgtcaatttaagcgatgatttagcgcttgcgcttgctgcgaaggatatcaggatcgaagcgcctataccaggcaaatcagcaatcggaattgaagttccaaacgcagaagtggcaatggtttcgctgaaggaagtgctggagtctaaattgaatgacagaccggatgcgaagctgttaattggactcggccgcaatatttcaggtgaagctgtattggctgagttaaacaagatgccccaccttttggtcgcaggcgcaaccggtagcgggaaaagtgtctgtgtcaacggcattattacaagtattttaatgcgcgcgaaaccgcatgaagtgaaaatgatgatgatcgatcctaaaatggtagagctaaatgtctacaacgggattccgcatttgcttgctcctgttgtaaccgatccgaaaaaagcgtcgcaggctttgaaaaaggttgtcaatgaaatggagcggcggtacgaattattctctcatacgggtacaagaaatattgaaggatacaatgattatataaaacgcgccaacaatgaagaaggagcgaaacagccagagctgccctatattgttgtcattgtggacgagcttgccgatctcatgatggtcgcttcatctgatgtggaagattcgattacgagattgtcccaaatggcgcgggctgccggcatccatcttattattgcgacacagcggccatcggtggatgttatcacaggggtgatcaaagcgaacattccgtcacgaatcgcgttcagcgtatcttcacagacggattcaaggaccattcttgacatgggtggcgctgagaagcttcttggccgcggcgatatgctgtttttacctgtaggggctaataaacctgtccgtgtgcagggagcatttttgtcggatgacgaagtggagaaggtcgtcgaccatgtgattacgcagcagaaagcgcaatatcaagaagaaatgattcctgaggagacaacggaaactcattccgaggttactgatgaactttatgatgaagctgttgaattaatcgtcggcatgcagacggcatctgtttcaatgctgcaaagaagattcagaatcggctatacgagagcggctcgcctgattgacgcaatggaggaacgcggcgttgtcggaccgtatgaaggcagcaaacctagggaagtattattatcaaaagagaaatatgatgagctctcttcttaatgaagggagttccgctttctatagttgtcaataataacattatgtaaactgatcacctttctatttattttttcgacaaaacatgatatagttgtcccaattgttcaataatttttatcgaaagtggtttacggaggggaaacatgtctacaaaagctgataatcggcacttgtatttgaaagtaattgaacgaattaaagaggatataaaaaatgggatctacactgagaaggaaaagctgccttctgaatttgagctttccaaaaagcttggtgtcagcagagcgacgctaagagaagccttacggatactggaagaagagcatgtgattatcagaaggcatggtgtaggcacttttgtccattctaagccgttatttctttcgggcattgaacagctgaacagtgtaaccaagatgatagaacaggcgaatatgacccctggcacgatttttctatcatcacaagtgcttatgccgtctgaagatgatacgaagagatttcatttggcagaagggcaagaacttttttaccttgaacgagtcaggacagctgacggacagccgattgtgtattgtatagacaaaattccgatgaatattttgccgaattctttttctcatcagcaagaatctatgtttgacctgcttgagaaaaattcaggctccgtaatcagctatgcagtaactgatatagaaccgatcggttatcacgatacaatttctccagtacttgaatgcgatccggaaacagctcttttactgttaaaacaaacccattacgatcagcacgataaaccggtgctttattctttaaattattttagagcagataaattcagatttcatgttttgcgtaaacgattctaaaaacggacgcctgtatgtgtctgtttttttatttgcactgattcatgtttctttgtacatactttcattccggttaacgcaatatataagggatgacaagaaagtgaatgggtgaaaatgttgagagagaaaaatggaatgaaaaatattattgcattgtcttccgtcccgcttgtgatgacactcgggaactccatgctgattcctgttcttccgatgatggagaaaaagctgtctgtgacttcatttcaagtgtctttaatcattactgtatattcagtagtagcaattatttgcattccgattgccggatatttgtcggatcgtttcgggagaaaaaaaatattgcttccttgcctcctcattgcaggattggggggagcggtagctgcttttgcctcgacctatatgaaaaatccttatgctatgatcttggcggggcgggttcttcaaggcatcggttctgcaggtgccgctccgattgtcatgccgtttatcggcgacctgtttaaaggagacgatgaaaaggtcagcgccggtcttggcgatattgaaaccgccaacacgtcagggaaggtactgagtcccatacttggagccttactggcttcttggtattggtttgtaccattttggtttattccgtttttctgtttgatcagctttttgctcgtattgtttttggtggccaagcctgaagaagatgaagatgcgcctgctgtttctgagtttattaagagtgtgaagaaaatttttaaacaggatggtcgctggctttatacggtcttcattatcgggtgtgtcattatgtttttgttatttggcgtattattttatttatcagatacgctggagaacaagtatgctattgacggagtagctaaaggcggattactggcaatcccacttttgtttttgtcaaccagttcttttatagctggcaaaaagatcggtaaagataaaggccgaatgaaattttgcgttgttacaggaatgattctgttaaccctttcgtttattgccttgtggtggaaccacagtttttattttttatttgtctttttaagctttggcgggattgggattggaatggctcttcctgctttagatgcattgataaccgaagggattgaaagtgaacaatgcggaaccatttcctccttttacaatagcatgcgctttataggagtagctctcggtccacctgtttttgctgcattaatgtctaatgcaaactggattattttcatactctcggcgttttgcagcatcgtttctttatttttagtgctctttactgtagatgctaaaaaaagtgaagaagaagaaaaaaacttagggacggtctagccagccgtctttttttgcgcttccttgcacagtttacaactgtacctatacagcatgcggaggttattgtttccttataaatcctacagttgctataattacatgaaagagtgtttctgcggatgctgaaaattggtcataatacatactaattaagaaatgaacgaaggaggttccatatgtcatatgttaatgaactcaaatcaaagcacggcggtttaaccgcacacattgtaaaaacagaaaaattcaaaaccgtctcgcttatttttaagatgcttgcgccgctgacaaaggatcaagtcaccaaaagagcgctgctcccgcatgtgcttcttcgcggaacgaaaagccatccgaaaaccgcagaattgcgttcatacctggatgagctgtacggcacgtcagtatcggctgaccttacgaaaaaaggagagcggcacgtcattacgttcaggcttgaaattccgaatgaaaaatatttaaaagaccaaacgccgctacttgagaaagggctccagcttctcgcagaaatcgtcttttcacctgctttggagggagacgcttttcagtcacaatatgtggctcaagaaaaacggacgcttaagcaaagaatccaagccgtctatgatgataaaatgcgctattcgaatttaaggctgatacaggaaatgtgcaaaaatgagccttacgcgcttcatgtcaatggtgaaatcgacgatgtcgatgacattacggcagagcaattatacgaaacataccaaagcgctatccaaaaagaccagcttgatttatatgtagttggcgatgtggacagtaaccaggtacattcggcaattgataagtatttcaaaacagaagagcgaactcttggcacgattgaaaacaatcacgctgatgaaaaagttcagccaaaagaagtaattgatgaagaggatgtcaagcaaggaaaactgaatatcggctaccgcaccagcatcacttatacagatcaggattatcctgctttacaagtgtttaacggattgttcggcggattctctcattctaaacttttcattaatgttcgggaaaaagccagtcttgcttactacgcggcttcgcgtatagaaagttttaaaggcttgttaatggtgatgtctggcattgaagtgaaaaattatgaacaggcggtttcgattattgctgagcaattccaggcaatgaaaaatggcgatttcagtgagcaggatatagcacagacaaaggccgtcattcgaaatcaagtgctggaaacgattgatacagcatacggtttatctgaatttttatatcagcaggctgctgctcaagtcgagattcctatcgaagactttcttgccaatattgagaatgtcacaaaagaggatatcattaaagccggcgaaaagattcagcttgatacgacttatttcttaaaagggacggagggtgcatcttgatcaaaccaatcgaatatgaacagcttcaggagacgctgtatcatgaaaaaatgtccaacggccttgatgtttacgttttgccgaaaaaaggattcaacaagacatatgcggtctttacaacaaagtacggctcgatagataaccggtttgttcctttaggtaaaaacgagatggttcacgtgccggacgggattgctcactttcttgagcacaagctgtttgagaaagcggacggagacgtttttcaagatttcagcaaacagggggcttctgccaatgcgtttacgtcatttacaagaacggcttaccttttctcaagcacatcaaatgttgaacgcaatttagagacgcttatcgatttcgtacaggacccatattttactgaaaaaacggttgaaaaggaaaaagggattatcgggcaggagattaatatgtacgacgataaccctgattggaggctttacttcggggtcattgaaaacatgtacaaagagcatcctgtcagaattgacatagcgggaacagtggaaagcatttcacatattacaaaagaccttctttatgaatgctatgaaacgttttatcacccgagtaacatgctccttttcattgtcggacctgtagatcctgaagcgattatttctcaggtaagagaaaaccaggggaaaaaaccgtatactgatcagccggagatcaaacgggaagaagtgaaagagcaaaaagcggttttccgaaaagaaaaagagatcaaaatgaacgtgcagggaccgaaatgccttgttgggctgaaatccaaaaatccgtttaaattaggcaaagagctcttaaagcatgaactttcaatgaacttattgcttgaagctctttttggcaaaagctctgcccagtatgaatcactttatgaaaaaggatatattgacgaaacgtttagctttgattttactgctgaatatgggtttggttttgcggcgatcggcggagatacgcctgagcctgatcaattggctgaagacatttcaagcatgcttttgcgcgccggtgaactggttactgctgaaaagattgaacttgccagaaagaaaaagattggtacattcttaaaagcgctgaattcccctgaatacatcgccaatcaatttacccgttatgcgttcttggatatgagcctgtttgacgttgtaacggtactcgagcagattacccttgaggatgtccagaacgtaatacaagaggaaatcgctgcagacaggctgactgtctgcaaggttgttcctaaatcataaataaaacatccctccagtgtgaggggtgtttttctgcggaaagaaggaaagaggatgaacaaaacagcactaatcaccggagcaagcggcggcattggcaaaagcatcagcgaaacccttgcggctaagggatacaatctgctgctgcattacaatacaaatcaatacgcggcagcggagcttgctgaaaaactaagtcagatgtttggcgtaaatgcggagatattacaagctgatctgtctgcgcaagatggagcagataagctgacaagttcaattgttcagccgattgatgcgattgttttaaacagcggacgaagccattttgggctgattacggatgtagataacgcaacggttcaggaaatggttcagcttcatgtggcaagtccgtatatgctgacgagaaaccttctgccaggcatgattcggaataaatcgggagcgattgtggctgtcagctcgatttggggagagactggagcatcctgtgaagtactgtacagcatggcaaaaggagctcagcattcatttgtaaaaggattggctaaggagctggcaccaagcggaatcagggtaaacgcagtagcgccaggtgcagttgatacaaatatgatgaatcaatttaccccggctgaaaaagaagagatcgctgatgagattccgatcggccggctggcccggccgcaagaaattgctgatgcaacagcttttctcctgtctgaaaaagcgtcatatatcaccggccaaattctgtcggtgaatggcggctggcactgttgacacgaaaatattcggtgtatagtttcttttgtgaaggacacaataatcttgtaacttcacatgaaatggaggaaacaagcatgtcagtattagaaaactgggatagctggaaaaacttccttggcgaccgtctgaactatgcgcaagataaaggtatgagccaggatacgattacagatcttgcgacagaaatcggcagctacttggctaatgaagtggaatctaagaacgagcaggaaaaagtgctggcagatctttggagtgtagcatcaaaagatgaacagcacgccattgccaatatgatggttaagcttgttgaaaataacagcactcactaggaagagaggggatttttcctctcttttttatgttttcctcatcacagcaacattcttctttctaattagagaaaaatgctttatgataaaggaaggtaaaattttgccacaatgaagggggtatatcatttggcaaagctcgaatggtattttgaatatgaaattcaagtgaaccgccccggactgctcggggatatttcatctcttcttgggatgctttctatcaacatcgtaacgataaacggcgtcgatctttccagaaggggaatgctcctcaggtgccgccatatagatcaaattaaacgattagaatcaatcttaaaaacgatggaaacaattaaagtaacgaagcttagagaaccgaggcttcgcgaccgacttgccgtacgccacggccgttatattcaacgggatgccgatgacaagaaaacgttccgctttgaacgggacgagcttggcttattagtcgattttatggccgaattgttcaaaaaagaaggccataaattaatcggaatcagaggtatgccgcgtgtcgggaaaacggaatcgattgtagcctctagtgtgtgtgcaagcaaaaggtggctgtttgtgtcatcaaccttgctgaagcagaccataagaagccagctgattgccgatgaatacagcactgaaaatgtctttatcgttgacggaattgtgtcaacacgaagaggatcggaacgccatctccagctggtccgagaaatcatgcggctgcctgcaacaaaagtggtggagcatccggacatattcgttcaaaatacagagtatacactagatgactttgattatattattgaactgagaaatgaccctgatgaggttattacatatgaacatgccgaggaaccccaaatgtttgatcaatccgggttttcaagctttgatttttaaaattggaaggtgtttgttgtgactgaactaggaatccggctcaaagaagccagagaggaaaaagcaatgtcattggatgatctccaagcggcaacaaagattcaaaaaaggtatttaaccgccttggaggaaggaaactatgacattattccggggaagttttatgttcgggcattcatcaagcaatatgcagaagccgttgggcttgatgcggatcagctgtttgaggagcataaaaaagatatccctaatacgtatcatgacgatgtgtctgaaaagatctccggcatgaatcttcaaaaggaaatgccgaagccagcatctaaggcgctggagctgctgccaacgatacttgttattctcggcgtgattgtcgtgattgccattgtgtacgcgatcattcagtttgccaatcacaaaaacagtgatgatcacaatgcggcatcagaaaaagcaattacgcaaagtgagagcaagtacgaaatccctaaagattcaacgctgaaagagaatcaaaataacagctctgaaaaagagacagacactaaaaaagaaacgaaagaaaacgaagataagaaaaaagaaaatgacagtgataagctggagattaaagttgctggcactgaaggatcgttaacgacttatgaagtgtccggcgctgataaaatcgagctggaactgaaggcatcagacagctcctggattcgagtgcgcgatgaaaacagcagctctttaaaagaaggaacgctgaaaaaagacgagacctataaaaaagacataactgatcagaaacaagttgatatccgcaccggatatgcacctaatctgaaaataaaaatcaacggtaaggttctttcatatgaacttgatccgaaaaaagtgatggcacaaactataaagattgtaaataaaaaggaagaaaagtcatcttaattaccagatgacttttcttcacgtccgagtatgaaattggaggggctttatgtttaacttaccaaataaaatcacactagctagaatcgcattaatcccaatcttcatgattatcatgctggcgccgtttgactggggcaggctcgaagttggagacgaatcgatcccggtcgcacatttggcgggggccattctatttattattgcatctacaacagactgggtggacgggtattatgcccgaaaattgaatctcgtaacaaacttcgggaaatttcttgatccgcttgcggacaaactgctggtatccgcagcgttaattatccttgttcaatttgatctcgctccagcttggatggtcattgtgattatcagcagggagtttgccgtgacaggtttaaggcttgtcttagccggaacaggagaagtcgtagctgctaacatgcttggtaaaatcaaaacctgggcacagattattgcggtatccgcattgcttcttcataatcttccatttgaacttgtgtcattcccgtttgcagacttggcactgtgggtagccgtcttctttactgtcgtctcaggctgggaatatttctctaaaaactgggaagcgttaaaaacatctaactaagaaagaaggacttcgtcatggaatttccaaaaaaagcagaaataattgcagtcggttcagagctgctgcttggccaaatcgccaatacaaatgctcaatttatcagcaaacagctcgctgaaatcggggtcaacgtattttatcatacagcggtcggagataacccggagcggctgaagcaggtcatccgcattgctgaagaacgctctgacttcattattttttcaggagggcttggacccacaaaagatgatctgacgaaagaaacgattgcaaatacgctgggacgtccgcttgtgttaaatgatgaggcattccaatccattgaggactatttcaaacgaacaaaacgcacgatgtcacctaataaccgaaaacaggcgcttgtgatcgaaggctctgacgtgctggcgaatcactttggaatggccccgggaatgctcacagagcatgaatcgcgctattatatgcttcttcctggaccgccgagcgaattgcgtccaatgtttgaaaacgaggcaaagcctcttctgctgaaaaagatgggttcaaatgaaaaaattgtgtcaaccgttcttcgctttttcggtatcggtgaatctcagcttgaagccgatttggaagatattattgatgcgcaaaccaatccgacaattgcgcctttggcggctgatggagaggtgacgctgcgtctgacagccaaacacgccgatgaaaaggaaacagagcgtctgttaaaagaaacagaggccgttatcttagagcgtgtcggtgaatttttctatggttacgatgatacttctcttgtaaaagagctatctatagcgtgcaaggaaaaaggcattacaatttctgcggcagaaagctttaccggagggctgttttctgaatggctgacggatcatagcggtgcctcaaaattatttgccgggggcgttgtttgctatacaaacgacgtgaagcagaatgtgcttggtgtcaagaaggaaacattagatcgttttggggcggtcagcaaggagtgcgcatccgaactggctaagggtgttcaaaaactcactggcagcgatatcggcatcagctttactggtgtagcaggacctgatgctcaagaagggcatgagcctgggcatgtgtttatcggcatttccgcaaatggtaaagaagaggttcacgagtttcactttgcgggctccagaacggggatcagaaaacgcggcgctaaatacggctgccatttaatcttaaagcttttagagcaaaaataatattttcagcacattatcctcctaagaaaacatgatttctctgatacattatgatattttgataggaatcacgccaagaaaaaatccgaatatgcgttcgcttttttcttggcaaatcccttcaaacagggtatagtatatgtagtggtaacataaaggaggaaaaaatagaatgagtgatcgtcaggcagccttagatatggctcttaaacaaatagaaaaacagttcggcaaaggttccattatgaaactgggagaaaagacagatacaagaatttctactgtcccaagcggctccctcgctcttgatacagcactgggaattggcggatatcctcgcggacggattattgaagtatacggtcctgaaagctcaggtaaaacaactgtggcgcttcatgcgattgctgaagttcagcagcagggcggacaagccgcgtttatcgatgcggagcatgcgttagatccggtatacgcgcaaaagctcggtgttaacatcgaggagcttttactgtctcagcctgacacaggcgagcaggcgcttgaaattgcggaagcattggttcgaagcggggcagttgacattgtcgttgtcgactctgtagccgctctcgttccgaaagcggaaattgaaggcgacatgggagattctcatgtcggtttacaagcacgcttaatgtctcaagcgcttcgtaagctttcaggggccattaacaaatcgaagacaatcgcgattttcattaaccaaattcgtgaaaaagtcggcgttatgttcgggaacccggaaacaactcctggcggccgtgcgttgaaattctactcttccgtgcgtcttgaagtgcgccgtgctgaacagctgaaacaaggcaacgacgtaatggggaacaaaacgaaaatcaaagtcgtgaaaaacaaggtggctccgccgttccgtacagccgaggttgacattatgtacggagaaggcatttcaaaagaaggcgaaatcattgatctaggaactgaacttgatatcgtgcaaaaaagcggttcatggtactcttatgaagaagagcgtcttggccaaggccgtgaaaatgcaaaacaattcctgaaagaaaataaagatatcatgctgatgatccaggagcaaattcgcgaacattacggcttggataataacggagtagtgcagcagcaagctgaagagacacaagaagaactcgaatttgaagaataaaaataaaataagtttcaaatgatacaaaaggctgagtgaaaaactcagcttttttgtattttgcaaaaaaatgataaaaatattgctttttttgacaacttttttagggctttattcgtctaacaaaacgtgtgcaaaatggaatttattttgggaggaaaaatgaatgacaagcccaacccgcagaagaactgcgaaacacagacggagaaaactaaataaaagaggaaaactgttgcttggtcttttagcagtgatggtttgcattacgatttggaatgctcttcatcggaatagtgaagaaaacgaaccatctcaagaaactgcagcggtttcaaataccgatcagaaaaaagaggtcaaaaagaaaactgccaaaaaatcagaggaacaaatcaaaacagtggatcgaaatcaaaaaatcagcaattatttagaagaaatcggtttcagcggaacagccatgattgtcagaaatggagaaatcgtaacaaataaaggttttggctatgctgaccgtaaacactacattcaaaataatccattgacatctttttatgtcggttcatcacaaaaagcgctgattgcaactgctattttgcagctagaggaaaaggggaaacttcagacaagtgatccggtaagtacgtatttacctcattttcctaacggacaaacgattactttgaagaatctgcttacacatacatcggggataaacggacatattgaaggagacggcgccattacgccggacgatttaataaaagacatagaactgcagggaatcaaacgtcagccgggcgtatgggactaccaggattccaactattctgttctcgcttatattattgctgaagtaagcggtgagccctatgaacagtacataaagaatcatatttttaagcctgcgggaatgacgcatgcaggcttttacaaaacatatgaaaaagaaccttatcctgctgtcgggtataagatgaagggcggcaaaacagttacaccgtatatacctgatctatctcagctgtatggagcgggtgatatttatatgagcgctatagatatgtacaaatttgaccaagcgctgatagacggaaaactgtattcgcaaaaaagctatgaaaagatgtttacgccagggagcagctccacatacggcatgggattttatgttgatcccggaagctattcaaaccatggtgttatgcccggcttcaatatcttgaacagctttagtaaatctgggcaaaccattgttattttgttctcaaacattcaaaataatgctaaattgggccaagtgaacaataaaatataccagcttctgaatcaagaatgattggcgttcttcttttggatgaattgcattcggaacgtgaaaagacgactggcctgcaaacgttaagatggcaagcttgacaagtatttccgacacatttacaatgaagttgtaacatttgtttttttaacatgattgttaaaccatttaaacttgacaagggcgatgaacacactcattccctgtgaaggttctgtatgttgagaaaactagacaatgtacatgccgacactttttaagcaacaaccaagttcatagcaagaggaggtgaaagtatgaccccaattatgatggttctcatctccattttgctgattctactcggtttagttgttggctactttgttcgtaaaaccattgccgaagcgaaaattgcgggcgcacgcggtgcagccgagcaaattcttgaagatgcaaagcgtgatgctgaagcactgaaaaaagaagctctgcttgaagcaaaggatgaaatccacaaacttcgaatagatgctgaacaggaagttcgtgaaagacgaaatgagcttcaaaaacaagaaaaccgtttactccaaaaggaggaaaaccttgatcgcaaacatgagggaattgataaacgggaagcgatgttggagaagaaagatcattctctgaatgaacgacaacaacatattgaagagatggaaagcaaagtggatgagatgattcgtatgcagcagtcagagttggaacgaatttcgagtctgactcgtgatgaagcaaaacaaatcattcttgagcgggttgaaaacgagctttcacatgacatcgccatcatgacaaaagaaactgaaaaccgtgcgaaagaagaggcggataagaaagcgaaaaacattctttcactcgccttacagcgctgcgcagcggaccacgttgccgaaacaacggtatcagttgtcaatcttccaaatgatgagatgaaaggacgtatcatcggacgggaagggcgtaacattcgtacgcttgaaacgctgacaggaattgacctgattattgatgatacacctgaagctgtcattctttccggatttgatccgatcagacgtgagacagccagaattgctcttgataaactcgttcaggatggccgtattcatccggcacggattgaagaaatggttgaaaaatctcgccgcgaggtcgatgactatattcgtgagatgggtgagcaaacgacatttgaggttggcgttcacggcctccacccagatctcatcaagatcctcggccgcttaaagttccgtacaagctacggtcaaaatgtgcttaagcattccatggaagtcgcattcttggccggtctaatggcatcggagcttggtgaagacgcaaagcttgctaaacgtgcgggtcttcttcacgacatcgggaaagcaattgaccatgaagtagaaggaagccacgttgaaatcggggtagagcttgcgaccaaatataaagagcacccagtcgtgattaacagtattgcatcacaccacggggatgaggagccgacttccattatcgctgtgctggtagctgcagcagatgcgctttccgctgcaagacctggcgcaagaagtgagacgctcgagaattatattcgaagacttgaaaaactcgaagaaatttctgagtcctacgaaggtgttgaaaaatcatttgccattcaggctggacgcgaagtgcgtattatggtgaagccggattcaattaatgatcttgaggctcatcgactggcgcgagatatccgcaagcgaattgaggacgagctcgattatccaggtcatattaaggtgacagtaatcagagagactcgagccgtagagtatgcaaaataaagtgatgcgctaagcatcactttatttttttgacagcaaggaattttcaagaagaaaggatttacaaaatgagaattttatttatcggagatgttgtcggttcaccgggccgtgacatggtcaaagaatatgtaccaaagctaaaaacaaaatataagcctcactttaccattattaatggtgaaaacgccgcacatggaaaaggcctgacggaaaaaatttatcacagattaatccagtccggcgcagatgcaatcacaatggggaaccatacatgggacaaaaaagaaatatttgattttatagatgacgttccgaacttggttcgcccggcaaactttcctgaaggaacaccggggaaagggatcacatatgtgaaagcaaacggcaaagaactagcagtcattaatttgcagggacgtacgtttttgccgccgcttgatgacccgtttttaaaagcggatgaattgatcgcagaagctgcgaaaagaacaccgtacatttttatcgactttcatgccgaagcgacaagtgaaaagctcgcacttggctggtacacggatgggagggcgtcggctgtagtaggaactcatacacacgtgcaaacggcggataaccgcattttgccgaagggaacggcatatattactgatgtgggaatgactggcccatatgacggtatactggggatggacagagagacgattattaagcgattcaaaacgaaccttccagtccggtttactgtcgctgaaggaaaaacaacgctcagcggagttgtgattgacattgacgatcaaacgaaaaaagccgtgaaaattgagcgtattttaatcaacgatgatcacatgttctttgaatagttgaacatatggttattttataaaaatattaaaaagaaaagcaggaatatagcaactccttagtgaatatagtaaaaatggaaggtagcccgctatttttgaaaagcattgtggggatggctttttggatagcaacatctaataatgattgttctaatgaacactcacttatccattgtaaaactaagggggagcagaaatggaaatcttaaaagtttcagcaaaatcgagtccaaattcagtggcaggtgcgcttgcaggcgtgttgagagagcgaggagccgccgagattcaagcgatcggagcgggtgcattaaaccaggctgtaaaagctgtggcgattgccaggggatttgtggcgcctagcggcgttgatttgatttgtattccggcttttacagatattcaaatcgatggggaagaaagaacagcgattaaattaatcgtggagcctcgctaaaaacaaataaagcattctcaacctgtttgcgtaatgcaaacaggttgtttttcatttattgtgatattttctcccgatagtatttttagcacataaatgagcgaatatacaaaatcaaaaatgagctaaaacgtttcaaaaaaaattccgcccatttttcaagacagatacttttgtccttctggagaagacagtgctgtttacgcttattccatatcatggtacaatccgaatataacaagaatttttcaaggaggattgtacatgcagagtggaaagatgaaagctctaatgaaaaaggacggggcgttcggtgctgtgctgactgaagttcccattcctgagattgataaacatgaagtcctcataaaagtgaaagccgcttccatatgcggcacggatgtccacatttataattgggatcaatgggcacgtcagagaatcaaaacaccctatgttttcggccatgagttcagcggcatcgtagaggacgtgggagagaatgtcattagtgtaaaagtgggagagtatgtgtctgcggaaacacacattgtctgtggtgaatgtgtcccttgcctaacaggaaaatctcatgtgtgtaccaatactgctataatcggagtggacacggcaggctgttttgcggagtatgtaaaagttccagctgataatatttggagaaatcccgctgatatggacccgtcgattgcttccattcaagagcctttaggaaatgcagttcataccgtactcgagagccagcctgcaggaggaacgactgcagtgattggatgcggaccgattggtcttatggctgttgcggttgcaaaagcagcaggagcttctcaggtgatagcgattgataagaatgaatacaggctgaggcttgcaaaacaaatgggagcgacttgtactgtttctattgaaaaagaagacccgctcaaaattgtaagcgctttaacgagtggggaaggagcagatcttgtttgtgagatgtcgggacatccctcagcgattgcccaaggtcttgcgatggctgcaaatggcggaagatttcatattctcagcttgccggaacatccggtgacaattgatttgacgaataaagtggtatttaaagggcttaccatccaaggaatcacaggaagaaaaatgttttcaacatggcgccaggtgtctcagttgatcagttcaaacgtgatcgatcttgaacctgttattacccatcagtttccgttagaggagtttgaaaaaggtttcgaactgatgagaagcgggcagtgcggaaaagtaattttaattccataaagggggataaacatgacgaaggaatttgagtttttaaaagcagagcttgatagtatgaaagaaaaccatacatggcaagacataaaacagcttgaatctatgcagggcccctctgtcacagtgaatcaccaaaaagtcattcagctatcttctaataattacctcggattcacttcacatcctagactcatcaacgccgcacaggaggccgttcagcagtatggagccggcaccggatcagtgagaacgattgccggtacatttacaatgcatcaagagcttgagaaaaagctggcagcctttaaaaaaacggaggcggcacttgtattccaatcaggcttcacaacaaaccaaggcgtactttcaagtattctatcaaaagaggacattgtcatctcagatgaattgaaccatgcctctattattgacggaattcgactgacaaaggcggataaaaaggtgtatcagcacgtcaatatgagtgatttagagcgggtgctgagaaagtcaatgaattatcggatgcgtctgattgtgacagacggcgtattttccatggatggcaacatagctcctctgcctgatattgtagagctcgctgagaaatatgacgcatttgtgatggtggatgacgcccatgcatccggagtacttggcgaaaacggcaggggaacggtgaatcacttcggtcttgacggcagagtgcatattcaggtcggaacattaagcaaggcaatcggagtgctcggcggctacgctgcaggttcaaaggtgctgatcgattatttgcgccataaaggccgtccatttttattcagcacatctcatccgccggctgtcactgcagcttgtatggaagcgattgatgtcttgcttgaagagccggagcatatggagcgcttgtgggagaatactgcctattttaaagcaatgcttgtgaaaatgggcctgactctcacgaagagtgaaacgccgattcttcctattttaataggtgatgaaggtgtggcaaagcaattttcagatcagctcctttctcacggtgtttttgcccaaagtatcgttttcccgactgtagcaaagggaaaagccagaattcgcacgattataacagcagagcacactaaagatgaactggatcaggcgcttgatgtcatcgaaaagacggcaaaggagctccagctattgtaacaagaggaagagtttactcttcctcttttgattccttattgattattattctcaatgagtgtacaatgataggttgccagttgtgcagagcttcaataacctttatactgaagggtggaagtttggtttgaaaggagaaaatatgacatgaatgaaaaacaaaaattagagagcggacaagttaatccatcggacaaaaaatccgagaaggattacagcaagtactttgaagctgtttacattccgccttctttaaaagacgcgaaaaaacgaggcaaggaagccgttacttatcataatgactttaaaatttctgaacaatttaaaggattgggagacggaagaaagttctatatccgtacgtacggctgccaaatgaatgaacacgatacagaggttatggcagggatctttatggcgctcggttacgaagcgacaaactctgttgacgacgccaatgtcattttgttaaatacatgtgcaatccgtgaaaatgctgaaaacaaggtgtttggtgagcttgggcacttaaaagcactgaaaaaaaacaatcccgatctgattttaggcgtgtgcggctgtatgtcccaagaggaatcagtcgtgaaccgtattttgaaaaaacatccgtttgtcgatatgattttcggaacgcataacattcatcgcctgccggagcttttgtcagaagcatacctttcaaaagaaatggttgtagaagtttggtctaaggaaggggacgttattgaaaaccttccaaaagtccgaaatggaaaaattaagggctgggtcaatatcatgtacggctgtgacaaattctgtacgtattgcattgtgccttacacacgcgggaaagaaagaagccgccgccctgaagatatcattcaggaagtgagaaggctcgcaagtgaaggctataaggaaattactctgttaggccaaaacgtaaacgcgtatggaaaagactttgaagatatgacgtacggacttggtgatttgatggatgaactgagaaaaatcgatatcccgagaatccgttttacaacgagtcatccgcgcgactttgacgaccgcctcattgaagtgctggcaaaaggcggaaatctgcttgatcacattcatcttccggttcaatcaggaagctcagaagttctgaagctgatggcccgcaaatatgacagagagcgttacatggagctggtgcgaaaaataaagacagcgatgccaaacgcttctttgacaacggacattatcgtcggatttccaaatgaaacggacgaacagtttgaagaaacgctttctctataccgtgaagtggagtttgacagcgcctatacgttcatttactctccgcgtgagggcactccggctgctaagatgaaagataatgtaccgatgcgtgtgaaaaaagaacgcctgcagcgtctaaacgcactggtgaatgaaatttctgctaaaaaaatgaaggaatacgaaggcaaggttgtcgaagtattagttgagggtgaaagcaaaaataaccctgatattcttgccggctatacggaaaaaagcaagcttgtcaatttcaaagggccgaaggaagccatcggcaaaatcgtccgcgtgaaaatccagcaagcgaaaacatggtcgcttgacggagaaatggtaggagaagcaatcgaggtgaaataagatgacgctctactcaaaaaaagacattgtgcagcaggcacgaaaccttgcaaaaatgatttctgaaacagaagaggttgattttttcaaacgggctgaagcgcaaatcaatgagaatgacaaagtgtccacaatcgttaatcagattaaagccctgcaaaagcaggctgtcaatctgaagcattatgaaaagcatgaagcgctcaaacaagtagaagcaaaaattgacgcgctgcaagaagagcttgaagagattcctgttatccaggaattcagagactcgcagatggaagtaaatgacctactgcagctcgttgcacacaccatttccaaccaagtcacaaatgaaatcatcacatcaaccggaggcgacctgctgaaaggggaaaccggttcaaaggtgaagcattcaaataacagctgttctctctaaacacggtgccttaacaggcccgtgttttttcatcatttgtgcggttataaatgaactaaataatctatgtactaaatattcaattggtttttctgtgctcagccgcgtgtaaactttatcgcacttataagtaaagtttctaggcacacctgcatacaatggaacagaaactttgtatttttatattttatttataaaaatgcacactagacaaatgcccagcataagataacacgaagaagaacaaggaggcatgccggaatgtctgaatacagggaaattattacgaaggcagtagtagcgaaaggccgaaaattcacccaatgcaccaacaccatctcgcctgagaaaaaaccgagcagcattttgggtggttggattattaaccacaagtatgacgctgaaaaaattggaaaaacggtagaaattgaagggtattatgatataaacgtatggtactcttacgcggacaacacaaagacagaggttgtcacagaacgggtaaaatatgtagatgtcattaaactcagatacagagacaataattacttagatgatgagcatgaagtgattgccaaagtgcttcagcagccaaactgccttgaagtgaccatttcgccgaatggaaataaaatcgttgtgcaggcagaaagagaatttttggcggaagtggtaggggaaacaaaggtagttgttgaggtcaatcctgactgggaagaggatgacgaggaagattgggaagatgagcttgatgaagagcttgaagacatcaacccggagtttttagtgggagatcctgaagaataaaaaagggactaggggagacagtacccccaagtctcttttttatattgatatatcattcttttatcactttttgtttatgttataatgaaggttggaaaatagaaacgttgatacatagtgagggattaaacaatggccggttatacgcctatgatacagcaatatttaaaaataaaggcagagcaccaggatgcctttttattttttcgcctgggtgatttttacgaaatgttttttgaggacgccaaaaaagcgtcacaagagctggaaattacgttaacgagcagagatggcggtgcggctgaaaaaataccgatgtgcggtgtgccgtatcattctgcttccgcgtatatcgaacagcttattaaaaaaggatacaaagtggcgatctgtgaacagacggaagatccgaaagccgcaaagggcgttgtgaaaagagaagtggttcagctgattacgcccggaactgtaatggacggcaaaggcatccatgaatcggaaaataactttatcgcatctgtttcagcctgctcgaacagatacggacttgcgctgtctgatttaacaacgggagaaaatttggctgttttgattgaacggcttgaagacgtcatatcagaaatttattcagtcggcgcacgggaaatcgtggtttcaggaagcttggatgccgatacagtggcacagctgagagagcggtgcggtgcaacaatttcaattgaagacggagaaacagacgaacacgtaacgatcattgagcacttaaataatgaagatataacaaaaacatttctgcgcttatatacgtatttgaaaagaacccaaaagcgcagccttgatcatcttcagcccgtgcaggtgtatgagcttgaggaagcgatgaaaattgacttgtactcaaagcgtaatctggagctgaccgaaacgattcgttcgaaaaataaaaaaggctcccttttgtggctgctggatgaaacaaaaacggcaatgggaggccggctgcttaaacagtggattgaccggccgcttatcagagtcaatcaaatcgaagagcgccaagaaatggtggaaacattgatgtcccatttctttgaacgggaagatctgcgtgaacgtttaaaagaagtgtatgacttagaacgccttgccggccgcgttgcattcggaaatgtcaatgcccgggatttgattcagctgaaggaatcgttaaagcaagttcctggcatcaaacagctggttgcttcattggctcatgacaaggccaaggaacgtgcaaagcgcattgacccttgcggggatgtacttgaactgctggaagaagcgctgtacgaaaaccctcctttatcggtaaaagaagggaacctgattaaagatggttataatcaaaagcttgatgaatatcgtgatgcaagcagaaacggaaaagactggattgcccgcctggaacagcaggagcgggaatacacaggcattcgctctttaaaggtcggctttaataaagttttcggttattacattgaagtgactaaagcaaacttgcatttgcttgaggaagggcgttatgagcggaagcagacgttaaccaatgccgagcgctacattacacctgaattaaaagaaaaagaagcgctcattttagaggcggaaaataacatctgtgagctggagtacgagctgtttaccgagctgcgcgagaaagtgaagcagtatattccgcggctgcagcagcttgcaaaacagatgagcgagctggacgcactgcaatgctttgcgacaatcagtgaaaatcgtcactacacgaaaccagagttctctaaagatgaagtcgaagtgattgaaggcagacacccggttgttgaaaaagtcatggacagccaggaatatgtcccgaataactgtatgatgggcgataacagacaaatgcttctcattacaggtccaaacatgtcagggaaaagcacgtatatgagacaaatcgcgctcatttccattatggcgcaaatcggctgctttgtacccgcgaaaaaagcggtgcttccgattttcgatcaaatttttacgcgaatcggcgctgcagatgatttgatttccggacaaagtacatttatggtagaaatgcttgaagcgaaaaatgcgattgtcaacgcgacgaaaaacagcctcattctgtttgatgaaatcgggcggggaacgtccacttatgacggcatggcgctggcacaggcgattattgaatatgttcacgatcacatcggcgccaagacgctgttcagcacacactatcacgagctgaccgttcttgaggacaagctaccccagctgaaaaacgttcatgttcgcgctgaagaatataacggaacggttgtctttcttcatcaaattaaagaaggtgccgctgataaaagctatggtatccatgtagctcagcttgccgaactgccgggagatctgattgcgcgcgctcaagatattttaaaagagcttgagcattcaggaaacaaaccggaagtgccggtgcagaaacctcaggtgaaagaagagccggcacagctgtccttttttgacgaagcggaaaagccggctgaaacaccaaagctttcaaaaaaagaaaagcaagtgatcgatgctttcaaatcacttaatatactggatatgacaccgcttgaagcgatgaatgaaatgtacaagctgcaaaagaaattacattaaaacggggtgatgaatgtggcaaaagtcatccagctgtcagatgagctttcaaataaaatagcggcgggcgaggttgtggaacggcccgcctcagtcgtcaaagaattggtggaaaatgcgatcgacgctgacagcacagtcattgaaatcgatattgaggaagcaggccttgcatccattcgggtcttggataacggcgaaggaatggagaatgaagattgcaagcgagctttccgccgccacgcaacgagtaaaataaaagatgaaaatgatttattcagggtgagaacgctcggtttcaggggagaagccctgccgagtatcgcgtcagtctctcatctggagattacaacaagcactggtgaaggagctgggacgaagctcgtcctccaaggaggaaacatcatttccgaatcgcgttcctcaagcaggaagggaactgaaattgtcgtttccaacctgttttttaacacaccggcccgtttgaaatatatgaaaaccgttcatacagagcttggaaacattacagacgtggttaaccgtattgctctggcgcatccagaggtatcgatccgcctgcgacatcatgggaaaaacctgcttcaaacgaacggaaacggagatgtgcgccatgtactggcagcgatttacggcacggctgtcgccaaaaaaatgcttccgctgcatgcgagctccttggattttgaagtaaagggatatatcgccctcccagagattacacgggcgtcgagaaactatatgtcgtctgtggtcaatggccgttacattaaaaatttcccgctcgtcaaagcggttcatgaaggctatcatacgcttctgccgatcggacgccatccgattacttttatagaaattacgatggacccgattttagtcgatgtcaatgtgcatccatcgaagcttgaggtccggctcagcaaggaaacagagcttcatgacttaattcgtgacggaattaaagatgtatttaaacagcagcagctgattccgagtgcccagcttccgaaaaaatcggcacctgttatcaaaaatgagcaacagttcataacctttgatgaaaagcctccggaaagaaaagtaccggaaaaagcgcatgcgccatcttattcaccaatgaagctcagctcagtcgtgaaagagccgattgatgcggaggaagaattgcctcctctccaatttgatgctccatctatcgttgatcaggaacaaacccttgaggtgtccgatgtttcagaagaactgcctgaaacatttgagcaggaatgccatgaggaacagcagcagccagcgtctgagcgggttccgattatgtacccgatcggccagatgcacgggacttatatattggcacaaaacgaaaacggcctgtatattatcgaccagcacgccgcccaagaacgtattaaatatgagtactttcgtgaaaaggtgggggaggttgagcctgaagtgcaggatatgattgtaccgctgacgttccactactccacaaatgaggctttgattattgaacagcacaaacaagagctcgaaagcgtcggtgtctttttagagtcattcggctctaacagttacatcgtccgctgccacccggcctggtttccaaagggagaagaagcagagcttatagaagaaatcattcagcaggtgctcgactccaaaaatatagatattaaaaaactccgcgaggaagcggcgattatgatgagctgcaaaggctccatcaaagcaaatcgccacctcagaaacgatgaaatcaaagcgcttctggacgacctccgaagcacatcagacccatttacatgcccgcacggccgcccgatcatcattcaccactcgacatatgagatggaaaagatgttcaaacgcgtgatgtagcggggttggtnnnnnnnnnnnnnnnnnnnnnnnnnnnnnnnnnnnnnnnnnnnnnnnttggagtgtcagattataagaaacggttgtaaacgtgtgagcagtgttaacgcattatacttcatggttcctctgtataacaaaatttccatttacaggcaattgggattaatgtatattttgggtgagggggtggaagcacatggcatgtggtccgaagatcattatctttttggatgaacttgatgatccgaatgtaagaatcattttagaatgcagaatttaattacaacattgtgttttgctccctgttcgtgtgaacagggagtttttttcgtttatataactggtgatgtccaaatatagggtgttatgaatttcccatatctgccatcggcattttaagctgcttctctattaggctggttatcaaaagcaagttcaatgaaagccatgaaagctgatatcacaacaagcaagacatctggaatataaatagactgcataaagtaatctgcaaaacagatcgttataagattgctgataaaatacagtataaaagcaaaaagtgcagtctttttcaatgaaagtgattttgccaaaatgatagagataatctttgtgagtgggtctatgattaaacctacagcaaagcaggctaaaataaataaagctaatgtttgattggaagcgtatgtgatgccaagtatggagaataagcctttcatcccgaagaaaaagccgccgaagatgactgcaagcgcaatggccgcgataaaagtgatagatacaattccgattaattttgatctcaggttaaaatctttagagtgctcgttctgttctttttggttcaagtatgacactcccttcccctgcttactcatacaaacagcacccttgaatcagcccaaaatatctataagtctattttctgacgaaaatagtatagcatattttaacaaaaccaaaaaaggtccttttcactggggaagggcctttttcttcatgttaactcctgagattcgccgaagctttctctttttttggccaaataaaatagctggctgtaatgagaaagtcaatgcctataatgacagtccacagtttaagaatgccgctcaacgcctcggttcgggcagagtcattgataaaatagatcatccctgccaatagtcccgcaccaattaagtaggccagcacatgtcttagccagcctttcgcaccgtgcttggcatggtccattccaaaacgtttcagcggttttgcgcctttttttgtcacataatattggaacttttcatctgcccattgaatcatttgttttccataagcgatcgatataccgatgtaaacagctgcaatcccatgggctgcggtcgctgaggctccgcggtaaaggtccacaccagttgccgctaacaaaatcaaatcgataactggagttaagccaaggaatagcagtcctaatgtatgtcgtttgaatacgtaacgtacagcaagccccaatacaatgacaacccaaaacgcaatttcacagaaaacaatcatccatgcgataccgttcaatccattcccctcttttcaatacagttgtattatttaaataatatgttaccatctttgtttttgcaacacaactgtattataaaaattgccctctcatttttttcttgttacaataaagctatgccaaaacaaattgaccatgagaaaagaagaaaacaaattgcagaagcaacgtggcgcgtcattttagaacgagggatggagggagcatcagccaggaacattgcaaaggaagcaggattgtcattaggtgcactgcgccattatttctctacacaggatgaattgcttgcttttgcaatgaaacttgtccaagaaaaggtgactgaccgaattaaggacattgcagtgagggatttgctccctaaggaaaaagtgttgcaaattttgcttgaaatggtcccaacgaatgaagaaacgattagagagatggaggtttggtttgcttttactgcttacgccagacataaaaaggatatgtttgatgcgaatcatgacgggattttcagcggcatgcggaatctgattgcctatttagatgaatccgatttactgaagcagaatgctgataaagacattgaagctgagagactttacgcgcttgttgacggcttggctttacatgccatgcttgaccctgtgcgcgtgaataaagaccgaattaagcgggtcattatgcagcatgtagagtcaatttgcgtggaaggtaaacgtgagacagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcgatataaagcagcgcctttgaacgaaagctcaaaggcgctacgctgtattattttgatgaaagtggctttcagctgtgctggatatcaattgtatatactgcacgatctgttacgaccttcaatccttcgttttcttggtgaatatgaatttcacctaataaaggaatctcataggcattttgcggaagcggtacgtttccgtcctcagtgaatgttgttccttcgccttctaaaacgagctcttcttttgcaacataatcatcaggatgattcgtactgcgtatagccactttttgaaggtggagaacaatctgatccaagtctgatatctcttcatcatgggtcaattcaccttttctaatatcaagcgtctggccgacttttgattccagccattgagaaagctgtgtattcgtgtgtgccatcaatattcctccttttgatctacacgatactattcccaattgctgcatcttttacacggaaaagagccgcctcactctttatgtatgaaacaattcgctgttgagagccttgatatagcgtacggcagaacgctggaccgcttcgccggcattttctttgacaactttagaaaaagcattgtaaagccggttgaattgaagcggttttactttggctgctatttcttcaactttggaggcgggaaggggaatgagatttgggtagctgtacataaagctgacccagtttcggtccgccgcaaccgtaatgatatctccggtcaatagacagcctttcccttcattgcccttgctccaatgcaaaacagcaccgcctttaaaatgtccgcccagtcggtaaaggtccagtcccggcttcacgttgagcgtttcccctgaccagaagtgaatgtgattgcttggccttgtcacccattctttatcatcctcatggatatagatcggcgcctgaaacgcttcagcccactcaacttgagtagagtaataatgtggatgagacaaggcgatggcttgaataccgcctaattcgttgatttggtcaattgtcttttggtcaagatatgtcatgcaatcccacagcacattgaagcccttatgctggataagatgagctgtttgtccgatcgcaaactctggttcagttttgatgctgtaaagatgctcttcttcctttttgaggatgttttgaaggtttcctttctcacgcatgtcttcaagggttgtccaactttgtccatcgggatgaatatactgcctttcatcctcgcaaatcagacacgagttgggcggatctacagtctgtgcatgttgcacgccgcatgtgttgcagatataatatggcactttcttcacttccttcatctattttccattattttaccttatgattatgaatattcaaacaaaaaaccggcagttctgctgagagagaattgccggcttttgatgatgtttattggccgggaacggaattttctgcgttgacagcgcccgctccgtacacatttggatcttcatctttccatttgtccgtgccgtttttcaaaagctcttttacttcatcaggggtaagatccgggttgtgctgaagaattaaagctgcgattcctgcgcaaatcggtgttgccatcgaggttcctgacattgtaaagtactgagaccctacacggcttgacttttggagcttatcaatataagaattcggagagcgaagggaaataatattaacacccggcgctaaaatatcgggcttttctttcccgtatactgtcgggccgcggcttgagaaggaagcgacagtatcatcatcgctgcttgcagtattgttatcgtcaagcgcacctactgtaatcaccttttcgctcacgcccgggcttgcaatggtctgcgaatcagggcctgagtttccggcagcgacacagacgacaatccctgcgctccacgcttcctcaaccgctctgactaacggatcttcctgttcatgatcatatctaagggcatcgcccccgagcgacatgctaataatatcaatcggttcatcggggttgtcctcattgtattgaatacaccactcaacaccctctataatatctgctaacgttcctgaaccctgcttgtttaatacctttacgccgatgagattggcttccggtgcagggccgcggtattgaccggaagaggatgcaccgctgcttgcgacatcacctgcacagtgtgtgccatgaccattatcatcgtacggctctgttttttgattgaccatgtccgcgaatccgataattctgccttctagatcaggatgcgggtagattcctgtatcgacaacagcgacagtaacaccttttcctgtcagggtttgcccgtttctgacgacttccttcgcatggcttgcttcggttgccgtgtctaaaagcgctttgacttcgcggtttaaatacactttacggatattgctgcattcagagagaagggaatgtaatgctgaaggagtaacctccgcgctgcagcaattgattttgttgaagcggctttttagcttgctgcgtttttctttttgcagcacctctccagccatttgaaagccggtctcgtgacagccttcctcaaattcgataatgactgacattttttttctgttttgcaatttggtttcgaaaaatttatgcaagaagcaaggagtccatttgaagggcttgtaaagctgcaatacggtttcccgtaacggccaatctagcttgtgagcatttgctctcaccatttgtaccatagagtacccaaacatgtattttcctcctattataaggttctctgtatactctatgaacagatgataggtttggtaagtttgtttgtcctctataagagacagacaagagtttgtttttctgaatctttcgcattagatacgatagattcagaagttgaggaaatcattggggattgaaagagaacgtttgttcgtattataatgtgatcatatcaaactgggaaggggagagcaaccgtatgaatttctacttgcaccgatctttggaaagccaaatgccaatcagcattatatatatgaagaaagacggaacgattagtaaaagaacgattattgtgagacagaaaagcaaaacgaaaatcagcattttgtttttcgaaacaacagatcagaacatttttattggactctatcctctcctgtgattttgtgagaacaaataagcaaaatctctattctgcaggccggtaacagctgtccgtctcagcaaccgggcagcctgttactaaaaccctccttaaacctatatacatttatttgccaagtgaggttgttcctaccttttttgtctttcctctcaaccttttttcactcttatttgaaatgaaccgctaataaccgtgacaatcaattgattttttgaaaccgggaactttttcactgatgatattgtgtatacaatggtaagataaaacctattggctaaacctcatataatgaaccgcgccattcttatgaaaggagttaaacatgagaagatttttactaaatgtcatattagtcttagccattgtcttgttcttgagatatgttcattactcattggaacctgaaccatcaaatcagccagatacatattcaaatttcagcagcttggcagagaatgagagcccagccgattacgatatttcatataatgagaaaaaaggaagcaaagtcttaattatgtctccgcatggcggaagaattgaaggcggagtaagtgagcttgtgcgttatttcaataatgaatactctacatacctgtttgaagggttgaagtcccacgataaccaaacgctgcacattacaagcaccaactttgatgagccattggcaaaaaagaaaatcaaggagcatcaatatgtggtggcttttcacggatataaaggagagaacaagaatacgcttgtagggggaacagaccgaaagcgggcgaaaatgattgtgagagcccttgagcggagagggttttccgctgagttagcgtcgtctaaaagcggtcttgctggattgaatgccgaaaacattaataaccaaggggaaacgggactaagtatccagctggaaatcagccgtgagcagagagaagcattttttgatgatttttattataaaaatagaaaatacacaaagaacagtgaattttatgcttatgtcagtgcgatcaaaggtgtcctggaaaaagagtattcgtaacaagcagatcggaagacaaaataagagaagatcagtagactgaaataggataaaaaaggaggcaaaacaatggcagatcatcatttttatttaaaagcgaattggccgggtaaccgcaatgatgtcggtacgatcgaaagcggaaacctgatcacatcgatttccattcctaaagaaatggatggcccgggagaagggaccaacccagatgaaatgcttctcggggcggcagcgacctgttacattattacacttgcagcgatgatggagagaagcgggctggaaaaagaagacttacagatggagtcagaaggcattgtcgacgtcacaaaaggagtctttacatacaaaaagatcattcaccgtccctctgtcgtgcttaaacatgatgcttcacaagacgacgtcgcattggcgcacaagctttgtaaaaaagcggagtcgtcatgcatgatttcgcgtgcaattcaaggaaatgtcgagctgcagcttgaagcctctgtgaaactgggtggagaataaagaaaacagacggtcactcacaggccgtctgttttttatcttcagcgtgggctttcgattgatttagcacgaccacgcctgcaatgacaagcgtgagaccgaatacaccttttaaactgatggtttcgccaaaaagcaaaaacccgacaattgctgtaagcgcggtaccaacgcccgaccatgttgcatacgcgcttgataagtcaattgtttttaaagaaaagcttagaaacgtaaaagcagaaagaaatccgactatgactccggcaatgggccaggcttgtgtaaatccttctgaaagcttcagcatcgtgctcccaaacacttcagatacaatggcgagagccaaataaagcaatcctctcatcttcatcactcctttactgccaattaagtaacacgacccctgatagtaataaaagaatcccgataagccctttggcattcagatcttccttgaaccattttactccgatcactgtcgtcagcaccgtgcccgccccgctccaagtcgcataggagaggctcaggggaatatggtttaaagtcagggacagcatataaaaggcgagggaatagccaataacgaccaaagcacttggcttccactttttgaagccatcagatacttttagcatggctgctcctatcgattccgaacatatggcaatcgtgaggaatatatatcctatcaacatcatgaattctcctcactatatttttagattagaaaaaacttcagctagaaaaatattagtgtatgcctatgtatgagtcaagagattcattttcacacacttaaaaagacccctttttaaggggtcttttgcgtttaataataaaaagggaacggggcatacggataataggggtatccgccatacaaataaggattaaataaagcgcttcctataagcccgcctgcaaggccgccgataaacggtcctccaaaaaatccgaatggcaggccaaacccataaccaaatccgggtcttccaaacccgtaaccgaacccgaacggtcttccaaacccaaatggtctcccgaatccgaacggccttccaaatattcttgtatcttcagggctgaaatgctctaactcgttcatgttttctttcctcctgtaataaagtgtagatgatgcagtgtattcaccctgcccggatttgattgggcgaatcgaggaaaaggaggatgtgaacacattgggcctgtatcagtctgactggtcaaaagcaccgccccacgcacatgcttatcatgtcaaaacaacgagagaacagggccattatcatctcatcgaagggtttactcagccggcaaacggatcaaataccgatcagcatacacattactatacagggatcacttcatttgaaaacggccattttcatcggtattacggaatctcaggaccggcgattcccttagcagatggcacacattatcatgaaatcgaagaaacgacgtatctggcctataacgagccgattgagatccagtacggaggggttgtgtacgatcccggagatgacagaagaaaaacgcatcgtcataccctgaaaggaaagacaagggaaattgtcggcaatgagccgctcggctggtagaaggatgtttaccgatgcaaaaaaagggcaaaatggataggtggttgtccatgttgaatgctataatggggggagatttataaaagagagtgatacatattgaataatacgaagcagcccgttgtcattttagtcggaccgacggcagtggggaaaaccaatttaagtattcagctagccaaatccttaaacgcggaaattatcagcggagattcgatgcagatttataaagggatggatattggaacagctaaaattaccgaacaggagatggagggagtgccccatcatctgattgacattttagatccccaagactctttctctactgccgattatcaaagcttagtaagaaataaaatcagcgagattgcaaatagaggaaagcttccgatgattgtcggcggtacagggctttatatacaatctgtgctttacgattatacatttacggaagaggcaaatgatcccgtgtttcgagagagcatgcaaatggccgctgagcgggaaggcgctgactttcttcatgccaaacttgctgcagcagatcccgaggcagcagctgcgattcatccgaataatacaagaagagtcattcgcgcactggaaattttacatacgtccggaaaaacgatgtcccagcatttgaaggaacaaaaacgagaacttctgtacaatgcagtgttaattggcctgacaatggatagagacacgctttacgaaagaattaatcagcgggtcgatatgatgatgcagtcaggccttcttccggaagtgaaacgcttatacgacaagaacgtgagagactgtcaatcaatacaggcgataggctataaagagctgtatgcatattttgacggttttgtgacactttccgatgctgtcgaacagctaaagcagaactcgaggcggtatgcgaaacgccagttgacgtggtttcgcaacaaaatgcaggtcacatggttcgatatgacaccgcctgttgatatggagctgaaaaaaaaggaaattttcacacatatagcaggaaaactcgaactttaatcgaaactgtatgatatagagaatcaaggaggacgaaacatgaaaccgattaatattcaggatcagtttttgaatcaaatccggaaagaaaatacgtatgtcactgtttttttgctgaacggctttcagttgcggggccaggtgaaaggctttgataactttaccgtattgttggaatcggaaggtaagcagcagcttatatataaacatgcgatctcaacgtttgcgccgcaaaaaaacgtccagcttgaactcgaatagatcaaaaaatgccatgtcaagacatgaggaaaggctgccgggggttcccggcggccatttttaacatgcatccacttttgctccaagctttttgtgtaagctgaccatgccaaggcacggtctttttttatgagaacaacatacggaagtaaaatggtatattatgtataaaatgaatttgggagtgatcgaccttgtttgaaagtgaagcagaactgagacgaatcaggattgcacttgtatggatagctgtctttttactgttcggggcgtgcgggaatcaagataccattattgaaacagacagcggcaattcagactatgaaacgcctcagcccacctcgtttccacttgaacataaccattttggcgttatggaggacggctatatcaaaatttatgagtataatgagtcccgcaatgaggtaaagctgaagaaagaatacgcggatgatgagcttgaataaaattcacaagcattcgaatttacaaagcggatgccagccgctaaactaaatacagacacagatcaaacagagggtgaaaacatgaagcataaagtgatcgtgaatcattgggaagaaatttgcgaagatgattcttgctatgaatacggaacaagtatcattgtgaacggaaaagaattaatcagagaagcgtcaattatcactgctttgaaggcggttttagaagagatcggcgcggatgttgaaatagaagaaacagtagagagcgaaaaatgctgtgatagcttaagaaaaaaaaatctagactactaagcagttttttttcatgttatgatatacatcggctaaaaacgacaccccgagtaggacgagagatgattctcgttctgctctcttttttgggccctaatgagtctgtccatttgcctgatttgatcaaaatatgaatttttcataaaaacgaatctatatattgtgtttttgctagagggtagtatactatatatagtgttagtgatgagagattcatattttttgataggtcgtgataaaacgtggtacaaatcatatttgattcgaaaacagggaatgttcagcggtttgtgaataaaacaggctttcagcagatacgcaaggtggacgaaatggaccacgtggacactccgtttgttttggtcacctacacgacaaacttcggccaggtaccggcatcaacacaatcatttctcgaaaaatacgcccatctcttattaggagtcgctgcgagcggcaacaaagtatggggcgataactttgcaaaaagcgccgataccatttcaagacaatatcaggtgccgatcttgcacaaatttgaactcagcggcacatctaaagacgttgaattgtttactcaggaggtagaaagagttgtcacaaaatcaagtgccaaaatggatccagttaaataacgaaatcatgatccaaaaagatggaaaattccagtttgataaggataaagaggctgtacatagctattttgtagattatatcaatcaaaacacagtcttctttcacgatttaaaagagaagctggattatttggttgaaaaccaatactacgaagaggaattcttaagcctttattcttttgaagacattaaagaagtgtttaagacagcttacgctaagaagtttcgttttccttccttcatgagtgcgtttaaattctataatgactatgctttgaaaacgaatgacaagaaaaaaatcctggagcgttatgaggaccgtatctcaattgttgcgctgttcttcgctaacggcgacactgagaaagcaaaagaatatgtaaacctgatgatcaatcaagaatatcagccgagcacaccgacatttctgaacgccggcagaaaacgccgcggtgaacttgtgagctgcttcttgctggaagtcaatgattccttaaatgacatttcaagagcgatcgatatctccatgcagctttctaagcttggcggcggggtttctcttaacctgtccaagcttcgcgcgaaaggtgaagccattaaagatgttgagaatgcgacaaaaggcgttgtaggcgtcatgaagcttcttgataacgcgttccgttacgctgaccaaatgggacaaagacaagggtccggcgcggcgtatttaaacattttccaccgcgatatcaatgattttcttgatacgaaaaagatttctgcggatgaagatgtgcgtgtcaaaacgctttcgatcggtgttgtcattccggataagttcgttgagcttgcacgcgaggacaaagcggcttatgtattctacccgcacacgatttataaagagtacggccagcacatggatgagatggacatgaacgaaatgtacgacaagtttgtcgacaaccctcgggtgaaaaaggaaaaaatcaacccgcggaaactgcttgaaaaattggcgatgcttcgttctgaatcaggctatccatacatcatgttccaagataacgtcaataaagtgcatgcgaataaccatatttccaaggtcaaattttctaacctttgctctgaagtgctgcaggcatctcaagtttcttcatacacagactatgatgaagaagatgaaatcggtctggatatttcctgcaacctgggttcgcttaacattctaaatgtcatggagcataaatcaatcgaaaagacagtcaagcttgcgacagactctttaacacacgtgtctgaaacaactgacatccgtaatgcgcctgctgtaagacgggcaaacaaagcgatgaaatcaatcggcctcggtgctatgaaccttcacggctaccttgcgcaaaacggcattgcgtatgaaagtccggaagcgcgtgactttgcaaacacgttctttatgatggtgaacttctactccatccagcgttctgcggaaatcgcaaaagagaagggtgaaacgtttgatcaatatgaaggctcaacctatgcgacaggtgaatactttgacaaatacgtttctactgatttctcaccgaaatatgaaaaaatagctaatctgtttgaaggtatgcatatcccgacgacagaggactggaaaaagctaaaagcatttgtggctgaacacggtatgtatcacagctacagattatgcattgcgccgacaggctctatctcatacgttcaatcaagtacggcgtctgttatgccgattatggaacgcattgaagaacgaacatacggcaactcaaaaacgtactacccaatgcctgggcttgcatctaataactggttcttctataaagaagcctacgatatggacatgttcaaggttgtggatatgatcgccactatccagcagcacattgatcagggaatcagctttacattgttcttaaaagacacaatgacgacccgtgatttaaaccgaatcgatctgtatgcacatcatagaggtattaaaaccatttactatgcaagaacgaaagatactgggcaagatagctgcctttcttgtgttgtttgattaaaggagagtttatagtgacaaaaatttatgacgcagcaaactggtcaaagcatgaagacgattttacccaaatgttctataaccaaaacgtgaaacagttctggcttccggaagagattgctttaaacggcgatctcctcacatggaagtacctcggaaaaaatgagcaggacacttatatgaaggtactggccggacttacgcttcttgatacagagcaggggaatacggggatgccgatcgtggctgaacacgtagacggccaccagcggaaagcggtgctgaactttatggcgatgatggagaacgctgtccatgcgaagtcgtactctaatattttcatgacccttgcaccgactgaaacgatcaatgaagtatttgaatgggttaaacaaaataaatatttgcagaaaaaagcgcaaatgattgtcgggctttacaaagccattcaaaaagatgatgaaatttcactgttcaaagccatggttgcttccgtctatctggaaagcttccttttctacagcggtttctattatccgttatatttctacggacaaggaaaactgatgcaaagcggtgagatcattaacctgatccttcgtgacgaagcgattcacggcgtgtatgtcggtctccttgctcaggaaatttataataaacagacagaagagaaaaaagcagagcttcgtgaatttgcgattgaccttctgaatcagttatatgaaaatgagcttgagtatacagaggacttgtacgatcaagtcggactctcacacgatgtaaagaaattcatccgctataatgcgaataaagcgctgatgaatcttggatttgatccatacttcgaagaggaagatattaatccgatcgtattaaacggattaaacacaaaaacaaaatcgcatgacttcttctctatgaaggggaatggttataaaaaagcgacagttgagccgctcaaagatgatgacttttattttgaagatgaaaaagagcagatataatatctgctcttttcggcttgaaggttcaaatgaggaggacgcagtacccatgggaaaaatggacgaaatgattttagttgccccgcgcgatgatgtgtttaagaaagaaagcttaaccttccagggcgtgtacagtgaagatagcagagtagccgaaatcatggctcagattgaagcggcctatcgtgaaatgagaagaggggacgcagaagaagatccgcgtttcaagcagccgataccttatgtcgtcattaagcgtgaagatgaagtttttctttacgagcggctggctggcggcggtgaatcacgactgcacaacaagctttctctcggctttggcggtcatatgaacgccatcgaaggggcagcttcatttgctgaagtcttaaagctgaacacagaccgtgagcttgaggaagaactgcaaataaatgaagaagataaacaggcgattgtcacactgggattgatcaatgatgatgaaaatagtgttggcaaagtgcatatcggtattctttctgcgcttcaattaaagcctggcgcacaagtggaagtgaaggagaaagaacaaattgcgggtaaatggatgaaagtttctgaattaaaacaggatgacatctacaaccgtctggaaacatggtcacagtttgttgttgatattcttgaataaaaaaacccggtttctcgcgatgaggagccgggtttttttatgagacgctcgtcccagtctcggctatgattctaggatcacaatagcgtcaaagccggcatttttcgctctgacagccagggtgtctgcattgtctttggatgaaaatgcgccaatctgcactttgtataatccgtcctttaaaaggacaatcgagtcaaaacctttggcttcggctttacttgcgagcgagtcggcattcgctttgactttaaatgcgccgatttgaaccttatataaccctaagctggaagtctttttaaggttaaaggcttgctccagcccgtttgcatgtcctctcgctaagctttgaataaaactgctcgttttcagcttatttgcatcggaaacggtatcaatgaagccgttctcggtcaagagggcaggcattgccgactcccttaggacgtggaagttcgctgtttttttgccgcgatcggcaaagtcgacagcttgtatcacttcagagtgaattgtcgattgataagtcgtcgtcggggctcctacatctggataaatatagctttcaaaacctgtgcctcccccggaattaacgtgaatggacaaaaagaaatctgctccccagttatttgcggcatttgtccggtcgtttaagctgacatattggtcgcttgtccggctcagcagcagagaaacgccttcatattcattagttaatatcgtacgtaaggctaaagcgatttgcagggttaacgttttttcctgaaggccattacctgttgcgcctggatcagacccgccatggccaggatcaataaaaattttaaccatttttcatcacctcattacaggatatgaaaaaacacggcttctgcttgtacgattatcattcaactgaaaaatgaggaaataatcctttcacatccagaaattatttctcgggaaagcgcacaattcaacatgaagcgacaacagatacggtctgaaatgaaatatgtacatataccatatgtttgtatgtactttgagttcggttaacctgcactgattcctgctggttttaagctttgcgttcatattaaatcaagcatttgaaacgtaaattgatgagaaaagctcctttcattaaagacaccactttataaatcgaaaaaaagaaaaacacttcaggtatcttagggcggataatacgcttcgtacaaaaaacagcccgttggatgaaaaaggattggcgaatggagaaaataatgaaaaagaagttcaccataatactctgacaaaatgattaaaaacaaaatctcatggtttgtccaccccatgtccgtgaatacaataagaaataaagtatttctcgggaaagcgcaggattccttattgttcccgaaaaaagcaattgtttcgacacatgataggcgtttgtcacaatcggcatccgcttgaatatcatatagagagaacagagaggtgaagatgttggagcgcgctgtgacttataaaaacaacggacagatcaacattattctgaacgggcaaaagcaggtgctgacgaatgctgaggcagaggcggaatatcaggctgcattgcaaaaaaacgaagcaaagcacggcattttgaaggaaatcgaaaaagagatgagtgcattagttgggatggaggaaatgaaacgcaacatcaaggaaatatacgcctggatttttgtaaaccaaaaacgcgcggagcaaggcttgaaggttggaaagcaagcgctgcacatgatgtttaaaggaaatccgggaacgggaaaaacgacggttgcacggctcatcggcaagctgttctttgaaatgaatgtcctgtcaaaaggccacttaatagaagcggagcgggctgacctggtcggggagtatatcggacacaccgcccaaaagacgagagatttaatcaaaaagtcattaggtggcattttgtttatagacgaagcctactcgctggcaagaggcggcgaaaaggactttgggaaagaagcgatcgacacacttgtaaagcatatggaagacaaacagcatgagtttattttgatactcgccggatattcacgggaaatggatcattttctctcgttaaatcccggtctccaatcaagatttcccatctccattgattttccggattactctgtgacccagctcatggagattgcgaaacgaatgatcgatgaaagggaataccagctcagtcaagaagcggaatggaaattgaaagattacttaatgacagtgaaaagcacgacaagccccattaaattcagcaatggacgttttgtcagaaatgtgatcgaaaaatcgatcagagcacaagccatgaggcttttaatgggagaccaatacttaaaaagcgacttgatgaccatcaaaagccaagatctttccattaaagaagaagcatctggatctgcatagacctctcagtttttgagaggtctgttttttgctcgtatttccgcttttcaaagcaatcgatttgtggtatacacatgcagggtttggtatgataatactactgcccaatatgcaaaagaaaggaacatccatttgaacgaacaagaaatgattcaggagaaagccattttagtcggatgtcagctgccgcatatcacggatgagcattttgaaaattctatggaagagctagcatctctgacgaaaacagcagacggaaaagtactgaccagcgtcacacaaaaacggaacagggctgacgccgctacatatataggaaaagggaaggtagaagagctgaaggcactggtggaagagcttgaagctgatctcctcatctttaatgatgaactgtcgccaagtcagctgaagtcattggcaacagcaattgaagtgaagatgattgaccgcacgcaattgatattagatatttttgcaaagcgggcgagaacgagagaaggcaaacttcaaattgagctggctcagctgcaatatgcactgccgcgtctgacgggacaagggatcaatctctcccggcaaggcggaggaattggggcaagaggtcccggggaaacgaaactggaaaccgaccgccgccatatcagaaatcgcattcatgaaatcaacacacagctttccactgtcattcgccatagaagccgataccgtgaaagaagaaagaaaaacggtgtgcttcaaattgcgcttgtcggctatacaaacgcagggaaatcaacatggttcaaccgcctgacgagtgctgacagctatgaagaagatctcctgtttgccacgctggacccgatgaccagaaaaatggtcctgccaagcggctacagtgttcttctttcagatacagtaggatttattcaggatcttccgacgacattgattgctgcattccgctcaacgcttgaggaagtaaaagaagcggatttgatcctgcatttaattgattcttcaaatgaggattatgcgggacatgaaaaaacagtgcttcggcttctcgaggagcttgaagcagatgatatcccgatgctgacggcttacaataaacgtgatcaaaaactgcctgattttataccgtccgccggaagggatcacattatggtcagtgcgaaatttgaggacgacgctgcagcctttaaagaagcgattcagcgctatttgcgccaagaactgttaacgtcttttgaagcacatgtgccggcaagtgaagggaagctcctttccagaatcaaatcggaaacgatggtagaccgcttctattttaatgaagaaaatgaacagtatgacatatccggctatgtccaagaagagcaaagtatcatcggtgaattaaagaagtatatgtaggaaggaaatataaagacatgtttgacacattaacacacggagaattattgaagaaaacggcaatggaagtggaagcggacattgccggcattcataaacaaatagaagaaatcagcgagcgaaatgagtggagagtgcttcaaagctatagaaaacacaaagtaagcgacactcatttcacgccgtctactggatacggctatgatgatatcggaagagacacgcttgaaagcatatatgcggatgtgtttggcggagaagcggggcttgtaaggccgcaaatcatttcaggcacacatgccatttcaattgctttgttcggtgtcctcagaccgggggacgagctcctttatatcacgggcaagccgtatgatacgctagaggaaattgtgggcgtcaggggtggagaaaacgctggatcgttaaaggattttcaaatcggctataatgcggttgaactgacgaaagacggaaagatagactatgatgcagtcgccgctgcgatcaatccgaagacaaaagtaataggcattcagcgctcaaaaggatatgcgaatcgcccttctttcttaattagtgaaataaaagaaatgatccgttttgtaaaagaaatcaatgaaaacctgatcgtctttgtggacaactgttacggagaatttgtggaagagcttgagccttgccatgtcggagccgatctgatggcgggatctctcattaaaaatcccggcggcggccttgcgaaaacaggcggctacctcgtcggaaaagcgaaatggattgaagcttgctcataccgtatgacgtcacccggtatcggcagagaagcgggggcatctctttactcgctccaagaaatgtaccaaggcttctttttggcgcctcacgttgtgtctcaaagtttaaagggagcggtgtttacagcgagattccttgaaaaactgggcttcacttcaaacccgaaatgggatgcgaaaagaacggatttgatacaatccgttgagttttctgacagagaaaagatgattgctttttgccaggctattcaatatgcatcgccaatcaatgctcatgtgacgccgtatccagcctacatgccgggatacgaggatgatgtcattatggcagcaggcacgtttattcaaggagcaagcatcgaattatcagctgatggccctatccgcccgccgtatgtagcgtatgttcagggaggattaacctattcgcatgtgaagaatgccatatgcagtgcagtggattcattgatggaaaagcaattaatttaaattttttaaaaatttctctggatttgatgttaagaatccttacatcgtattgacacataatataacatcacctataatgaaactaagttaagaaaaggaggaaattgagatgagtgataatattcgccgctcaatgcctttatttccaataggaattgtcatgcagttaactgagttatcagcaagacaaattcgatattatgaggaaaatggactgatatttccagccagaagtgaagggaatagacgattattttcatttcatgatgtagataaactgttagaaatcaagcacctgatagaacaaggtgtaaacatggcaggaattaaacagattctggcgaaagccgaagccgagccagaacaaaaacaaaacgagaagacgaaaaaaccaatgaaacatgatctgtccgatgacgaactgagacagctcctgaaaaacgagctcatgcaagccggccgttttcaaagagggaatacattccgtcaaggcgacatgtcccgcttctttcattaatccgttagcaactgttttgctatatacatttaccttttaagaggaggaattttaccaaatggcaaagtacactagagaagatatcgaaaaattagtaaaagaagaaaacgtgaagtatatccgccttcaatttactgacattcttggaacaatcaagaatgttgagattcctgtaagccagcttggaaaagcgcttgataataaagtcatgtttgacggttcttctattgagggattcgttcgtatcgaggagtcagacatgtacctgtatccagatctaaatacatttgttatcttcccatggacagctgaaaaaggtaaagtagcacgtttcatctgtgatatttacaatccggatggcacaccttttgaaggtgacccgcgaaacaacttaaaacggattctgaaagaaatggaagacctcggcttcagtgattttaaccttggacctgagcctgaattcttcttattcaaattggacgaaaaaggcgagccaacgcttgaactaaacgacaaaggcggatatttcgacttagctccaactgatttaggagaaaactgccgccgcgatatcgtacttgagcttgaagagatgggctttgaaatcgaagcgtctcaccacgaagtagcacctggtcagcatgaaatcgactttaaatatgctggagcagtccgctcttgtgatgacatccaaacatttaaactagttgtcaaaacaattgcccgcaaacacggcctgcatgcgacatttatgccaaaaccattgttcggtgtgaacggttcaggtatgcactgcaatctatcactcttcaaaaatggtgttaacgcattctttgacgaaaacgcagatcttcagttaagtgaaacagcgaaacactttattgcaggtatcgtgaagcacgcaacaagctttacagcagtaacaaacccgacagtaaactcttacaaacgtcttgttcctggctatgaagcaccttgctatgtagcatggagcgcgcaaaacagaagcccgcttatccgtatcccggcttcccgcggcatcagcacacgtgttgaagtacgcagcgtagacccagctgcaaacccgtaccttgcacttagcgtattgcttgctgcaggattagacggaatcaaaaacaaactggaagcgccggctccaatcgaccgcaacatctatgtgatgagcaaagaagagcgcatggaaaacggaatcgttgaccttccagcaacacttgcggaagcactagaagaattcaaatcaaacgaagtcatggtcaaagcgctgggcgagcacctattcgaacacttcatcgaagcaaaagaaatcgaatgggatatgttccgcacacaagttcacccttgggagcgcgaacaatatatgtctcaatattaatctctcaatcccttggcactattggtgtcaggggattttttgatttataatannnnnnnnnnnnnnnnnnnnnnnnnnnnnnnnnnnnnnnnnnnnnnnnnnnnnnnnnnnnnnnnttctttgtactaaattttcaatcagggaaataattccacgcttaaggaagtaatacgcataaataattcgacaaactctatgataattccattgttcaatacttctaccagcaataataagatgagtaaggtggatgtttatcattgacatcataaccaaataaatccataattacgttgaaatctaaatcaattttcaaaaaggagatttctatgaaaaaattgactatcttctccgggggattaggagcggttttttctgtactggctcaactgtttgcggttttagatgactcttacactttggggaacttatggtttttaggtgctttggcggggattataaccatgcttgcttcaatccatacaaataataaaccagtcttcagcatattattaattactagttcagtaataggtctacttggaactggtcttgtatacatcataccaacactgttcaatataataataatttataaattttcaaaagtaagccaaaagtaagccaatggtaaaataaaggttctttttttatttagtatttctttgacaaggtcggtaatgaatcgcagaatgcttatgcttgcaactggtccacacagctggggcttccgtgggcatgattatcgagcgccatggtttatgggataccggcattgaaacatttgccgaggcagtacgtgaagctgatcaccaaatgaccatttccatagaggcacgtctaaagaagctatcataggaggacaatactgtgtggaaagctttaagtcaattactcaagaaacagaaaaatcaaagtccaagcgatgaagattatatacagattccagaattagaagtaaaagttttggggatgcttcacagtatcaatatagacttggttaatttaatagctcaagcagaaaagtctaaggagtttataggacaaatcgaaggcatctggcattctatagcaaatcaattttattcactcgcccaagggtttgagaatgaggatatcaataagctttctgcggatcttgatcatgctgccgccacttgggaaactgttgctaataaagcaaaagagtttgtaacaaattcataccaagggtaaaagaaaaataagggcctgaaagggctcttttgcttatagtcatatttcccgtaagtattactttttggatttattaaattttaaagcgtgtttgtttcactgaattcatagtcaaaaggggaatgtttttatgcttggaatcaacgttgaaaaatcaaatgaaaacttaattatcaattggcagctatccaaaattgaaattccaatcaaagaaatcaatgatgtatttcttgatccaaactatgggggagaggagaaaagaggcagtaaggattgggtttccttatggctcaacagatagggtagtaattaaaacagcatataacacttacattttgttcaccactaatcctgctttaattatgagtaaaattgtttcttaataaacagtttatgtcccttttaaatttatcttaatgttctgtgtggtaaaatttagtgagatgatttaaggaggaggagcatttatggaagaaggaaagttagttcacatgacattagatggtattaagaaagcagttactaaatatggtacatttcctgtgttccatcatgggggttatgtcttggaagatgctacttttcatttcaaaaatccagcaactcctcaagaaattagcggcttagaaaagaaattaggtgttacttttcctaatgactttaaagagtttttgttacaacacaatgggatggaaatgtttgatggcattgaaatacttagcttagagggaatcgttgaatataatgaggttcaagatttcccagagggatacttattaataggatatcattttgatggaaggtatgtcatagacacaaacaaatcaaaaaaaggattaggttatatgttatatctagactcaattgacgatattgaagatgcgattaacttaaattctaattttgagatatggtttgatatgctagtgtcttctaatggaacgaaatattgggaagtaaatccgaatctccaagagtattataaactggtttcagaataacacttcggcaaaagaaaaaattatgacttattttaacaaccaaagaaactgcaaatttgagggaagtataatgacaatttacgagcaaattaaagatgctttaaaaaataagatcaatgagttggtttcacctcaagaagtaaagaaaacccttcaagaaaaatacggaactaatccggatagcattattttatcagattattgttataaccggtataataaggggatttcttttaataagcacctctttgaatatgtgaatagaagttcttacaaatacttaggtgaaaactctctttatacaggacttattttcagaaaatcaaaaggggaagataaggaagttatcgtaggcgaatgggtaaacggtgttaaatcactccgagaagtacctattactaataaccaaatacatgatcaagctgaaatcattagtaaagaacaacttgtaaacctttataatgaatataaccaaatcctgagatatgaaatgaatgtattgaactgtaagcccacagaattgaggcatttaattggcagaatcggtgaattcatttgtgcaatccaaaccaacggcactctggcacgtcaaactaatcagcatggatttgatgttgtgaatgatggcaggcggattagtgtaaaaacaacagctcaatcaagtggttttatttcgataaataaaaatacatttgatgattttgatgtttttttgtagttcaatacgtaaatgatgattttaaagttattttcttcagctcaaaggaagaagtgcaaaaaattagcagagtttatggaagccaatacgaagttgaaatttcacttcttaaaaagcttaataaggaataccaattaaattaaacaatcttgttgataacaaacatcctcttacttattgtaaggggatgtttgtttaatccttattttatcttcgcaatctggcttacgagttgcatccgcagtaaatgatcttacttcgtctttnnnnnnnnnnnnnnnnnnncataattatccctcagggaaaggtagggggattattttggagaatcatattccattgcttgttcacagtcagtaatccttgagttgttctagcaagaggcaatattgttgaataagaatagttttaaagaggttattgttgtcttcatattgaaataaagactaagtatattagaggggagttactttaatgcatatcacaacaaaaaggttattgatacgtgaatttgcattcacagattggcaggctgtatatgagtatacatctgatagtaatgtaatgaagtatatacctgaaggggtttttactgaagaagatgcaaaggcatttgtaaataaaaacaaaggtgataacgctgaaaaattccctgtcatactaagagatgaagactgtcttataggccatattgttttttataagtattttggtgaacatacatatgaaattgggtgggtgtttaatcccaattatcaaaataaagggtatgcttctgaggcagcccaagctatcttggaatatggatttaaagaaatcaacttacataggattatagctacgtgtcaacctgagaatattccctcataccgagttatggagaagattggaatgagaagagaaggcttttttaaaaaatgtattccaaaaggcaatgaatggtgggatgaatattattacgctattttagaggaagagtggaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattaaccgaaagtgagaatgtctaaatgaagataatggagtatatggaggaaaggtttcaaaacctcgaattcattcctagcatctataatcaatggggcataggaatccatttttgtcttgggaaaaatatctatcaactcaaagaaaatgaagaattgaatcttaagagatttcggtttgtatatgagcaaatctcaaccattttcaatcaattatttgaacaaaacgaagacatattcctcgtaacgaatatgtataagcacaagaaagagaaatgtataagaaaattaaaggtctatcaaccgtttctaaagtgtaaaaatcatttgaatcaaattctggtgaagacatatccctaccctttcgaaatcaataaagctgaagaatacgagatgcaacaattttccttgttatgcaaacctcgagacttacgtgtaactgaattacttaaagcagccagtaacgaggattttccattaaaaccgaaattcggaggttactctattgattaccctgatgttttctttgtgaacattacaaaagacattattttctttatctatgatgatcgtggatgtgaagtcatagctcttgatttcaaacgaatacgtccactttatgaaaaatatcacgactgggtagaagagtataagtgcatgtaatactcttttataaaacgatttatatcaggaaaggcagaattagattatgagggccttacatacaagatgtaaacggttattgaaactgagttggtcttaagtgatgatgagagatctgcatttttattagtagttgataaaagattagtggattttgattctcaaggtggaaaccttattagtgtttatttagttactcactttgagttatctgatcaatcgtataaagatgtactaagctttaatgatgatcttttgggtatgaagcataactgttcgtatgcaatggatattctaagcgctaaagaggaatttgatttcgatttcccatttaatatgcttgcaataaaaagctatgtacaagaattaataaaaatgttagggattgatataactctgcctgaaatgaaagaaagagattttgacaaactttctcaagattaaataaaactacgattttaaagagaacggagacttgctttcaatatgaatgttaaaaaactgcagctgttttttcaatcacgattccaattatctcagctatcctaattattaatttttttacgggagttatgtcaattccatggcaaggaatgccggtgttttttccattattactttctcctataggaatcattttagcgttcgtttcaataaagacaaataaacggtgtgctttatatgggattgtcttaaatgcaattatgtttccatttcctttttttggtttatcggaggggctttgttatttggagtttaatccattaggcattacgcttatacattggtattttcgaacttgtcaaaagaaggaataaaaaaatttcagaattgcttgcctttactttatgttgaaaggggtcgagtaaggtggataggaaaaagaatgaaatacaaagaaaatatagggaacaaatgagggagaagaaagaacgagaaaaagaagatggcagttcacatacttttgaaattgttgttgtgctagccattatcattttgatgtttttctttaattcagttttcaaggctttttagatattgtacagatgactttcaggatgtttgaaaaaattaccctttgagatatataccacatgaaagtattgaaggacttatgaaaattcaagagccagttgaatcttaataattaatcaccaaataatggggatgaaaaatgaaattgtataatgaatttatcaatatagctaaaacgtttaataaagagttagacataattccattattatatggatctttaggtcttgaaaaggtaactgggttagacttttctccagaagatattgatctccttattcctttaatttttttagaggaaaagtgggaaaaactaaaaaaagtgatggaactgcatggatacaaaatggttgatttacatgagcatgaatttaagaaaactaatactaaaataggcattgcttacatcgaggatttaaaaccatttgcagatgtagactataataacttagaggtatttgaggatggtggagcgaaatatcatttgctaacgattgatgattacctcaaggtttataaaaagtctttattagatggctatagaagaacaaagaagaactataaagaccaaaggaaaatcaatatattgaataaactaatacagaactgatttctgtattcctcttttgtttccaatttcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttaaactttctgaaaaagatgttgaaaaagttgaaaggattttataatattaaaacaagttagtttgtttgatcaacaaactaataagatgaactttcattatccacaagataaggtcttactgaatatggatggaagggggataagaggatcgatttaatggagctaaacaatataagaaacgaaagaatgaggcttttatccttttccaggtatataaggtatgaccaaaaaagatgaattttctgcttgctgatcaccatatttttttgcattgttttgaaagcgcttttataaaagtttactgaccgtaattcgagaaattgttataccgtttcacactgttccatattaaaggatcgaaaaggggagaaatcatgctcagtgaaaatgtaaagaagattagcatggttgaaaaagttggatatgcgtctggagattttgcttgtaatttaatttatgcaacagtgtctacgtatcttttgttcttctatacagatgtttttggtttatcggcagcagcagccggtactatgtttttagtggttagaataatcgacgctctcgccgatccttttatcggaacaatagttgacagaacgaacagcagatttggacgctttagaccgtatcttttattcggagcttttccatttgtcatactggcaatactctgttttacaacaccagactttacggatatggggaaattaatatatgcctatataacctatgttggcttgtcgcttacatacacaacgataaacgttccatatggcgcgttaacttctgcaatgactagaaataatcaagaagttgttagtataacttctgttcgcatgttatttgcgaatcttgggggacttgtcgttgcattttttgttcccttactggctgcttatttaagcgatacttccggcaacgagtctcttggctggcaactaaccatgggtattttgggaatgataggcgggtgccttttaatcttttgttttaaaagcacaaaagagcgggtcactcttcaaaaatccgaagaaaaaattaaatttacggatatatttgagcagtttcgtgttaatcgtccacttgttgtattaagtattttctttattattatttttggagtgaattccatcagtaattcggttggcatttattacgtaacgtataacgtagaaagagaggatttggtgaagtggtacggtttgataggaagtttgcccgctttggtcattttaccgtttattccaaggcttcatcaatttttggggaaaaagaaattactaaactatgcattattactgaatattatcggccttttagctttactgtttgttccgccaagtaatgtttacctcatacttttctgtcgattaatcgctgctgctggaagtctcactgccgggggatatatgtgggcgcttattcctgaaacaatagaatatggagagtacaggactgggaaaagaatgggtgggctcatttacgctataatcggatttttctttaagtttggtatggccttaggaggagttgttccgggtctggttcttgataagtttggatatgtagcaaatcaggcacaaaccccggcggcattaatggggattctaattacaacaaccattattcccgtgttcttgctggttctagctttaattgatattaatttctataacttagatgagaaaaaatataaaaacatggttcgagaattagagaatagagacaaagtttatttggatcatattgatgatttcaaagcttaaaaaagaaaataaactgaggaggagtcccaaatgaagattaccaatccagtacttaaaggattcaatcccgatccaagtatttgtagggtaggagaggattattatatcgctgtatctacatttgagtggtttccgggagtccagatacaccactcaaaagatttagtaaattggcacttagttgcacatccattacagagagtttcacaattagacatgaaaggaaatccaaattcaggtggggtttgggcaccatgtttaagctatagtgatgggaagttttggcttatctatacggatgttaaggtagtagatggtgcatggaaagattgtcacaattatttagttacttgtgaaacgattaatggtgattggagtgagccgattacattaaatagctcgggatttgatgcttctttgttccatgataaggatggaaaaaagtatttattaaatatgttatgggatcaccgtattgatcggcactcatttggaggaattgttatacaggaatattctgataaagagcaaaaattaatcggtaaaccaaaagttatatttgaaggaacggatagaaaactgacagaagctccgcacctttatcatatcgggaactattattatttattaactgcagaaggaggaacacggtacgaacatgctgctacaattgcccgttctgcaaatattgaggggccatatgaagttcatcccgataatccaatcttaacgtcatggcatgacccaggaaatccattgcaaaaatgtggtcatgcatccattgttcaaacacatacagatgagtggtatttagctcatttaacgggacgtcctattcatcctgtcgatgattcaatttttcagcagagaggatactgtcctttgggcagagaaacagctattcaaaaactctactggaaagatgaatggccctatgtagtaggtggaaaagaaggaagcttggaggtagatgcaccttctatacccgaaacaatatttgaagcaacgtacccggaagttgatgaatttgaggattcaacattaaatataaattttcaaactttaaggattccattcacgaatgaattaggttcattgactcaagcgtcaaatcatttacgattattcggtcatgaatcattaacttcgacatttactcaggcatttgtagccagacgctggcaaagtctccattttgaagcggaaactgctgttgagttttatccggaaaattttcaacaagccgctggattggtgaattattacaatacagagaactggacggctcttcaagtcacgcatgatgaagaactgggccgcattcttgaattaacaatatgtgacaacttttctttttcacagccattacacaataaaattgttattcctcgtgaagtaaagtatgtatatttaagagtaaatattgaaaaggacaaatattattatttctattcttttaacaaagaagattggcacaaaattgacatagcactggaatcgaaaaaattatcagatgattacatccgtgggggaggattcttcacaggggcctttgtagggatgcaatgccaagataccagtggtaatcatattccggccgactttagatattttcgttataaagaaaaataatttgcacatgaaaaaggagatttctattttagaactcctttttcatatgagaaggtgcctatgtcactattgcttcagaaatacccctagaattaaaaagctcatctttaaagatgagctgtacattccataaaaattacattgtaaccatgtccagaaaatgatcaatcacaatggaggacattcctaatgccggcgcattctgtcctaaggaagatggcaataattcatagctattgcctaattgggaataaacccttgatgatacttcacttctcattgaatttaaaaccataggatgcgattcaattatgctatttcttaaaattacggcctgtgggttgaaagtattcaaaatattggtaaggcctattcctaaatagaatccaaaattctgtaatgcgtttaaggttccgatatcattcagatgggcgaggtctatgatatcttgataggacagttttttcgctttagtctgaagagattttaataaagccttctctgaagcatacaattcccagcagcctcggtttccgcaactgcatttaggaccattaaagtctattgtcatatgtcccatttctccagagaagccgcttactcctctatataaatgattgttgataataacaccgatccctattcctgtgctgatacttacgtaaataatgttatcgtgattttttgcagctccaaatactttttctccatatgcgccagcatttgcctcattttcaataaaaacaggcacattgtacttctcttgtatcgaagattttaagtcaatatctctccagttggagttcggagtgaaaacaattttttgatctttatcaatgagtccaggcacgcaaatacctataccaataagcccgtacggagattggggcatttgcgtaataaagtgatgaatcatatcaatcaaaatgtctttcgttatttctggagaattggattccaaatggcggtattgatcaagaacgattgttccttcaaggtctgttaaaatgccattaatataatccacaccaacatctattcctacggagtatcctgcctttttattaaaaacaagcatgacaggtcttcttccgccacttgattgtccttgacctatttcaaataccagattttctttcattaacgtgcttacctgtgatgagacagttgatttatttaatccagtcatttcagataattttgctcttgaaataggtgaatttttaagaatttcttttaataataacttttgatttacttttttaacaaaggcttgatctgcgatatccacttcatccactccatttgtataacctttaaattaagtatgaacatagtacatagcgaatcttatctttattatatctaatgtgttcataaaaaactaaaaaaatattgaaaatactgacgaggttatataagatgaaaataagttagtttgtttaaacaacaaactaataggtaatgtacttactatatgaaataaaatgcatctgtatttgaatgaatttatttttaagggggaaatcacatggctcaatctcattccagttcaatcaactattttggaagcgcaaacaaagtggtttacgaagggaaagattcgactaatcctttagcatttaaatattataatcctcaagaagtaatcggcggaaaaacgatgaaagagcatttgcgattttctattgcctattggcatacatttactgctgatggtacagacgtttttggagcagctacgatgcaaagaccatgggatcactataaaggcatggatctagcgaagatgagagtagaagcagcatttgagatgtttgaaaaactagatgcaccattctttgcttttcatgaccgggatattgcaccagaaggcagtacgctaaaagagacaaaccaaaatttagatatgatcgtgggcatgattaaagattacatgagaaatagcggcgttaagctattatggaataccgcaaacatgtttacgaatccccgtttcgtccatggtgccgcgacttcttgcaatgcagatgtgtttgcgtatgctgcagcacaagtgaaaaaagggttagaaacagcaaaagagcttggcgctgagaactatgtattttggggcggccgtgaaggatatgaaacattgttaaataccgatttaaaatttgagcttgataatttggctagatttatgcatatggcagtggattatgcgaaggaaatcgggtacacagggcagtttttgattgagccaaaaccaaaagagccgaccacccatcaatacgatacagatgcagcaacaaccattgcctttttgaagcaatatggcttagacaatcattttaaattaaatcttgaagccaatcatgccacattagccgggcatacattcgaacatgaattgcgcatgacaagagtacatggtctgcttggctctgttgacgcaaaccagggtcatcctcttttaggctgggatacggatgaatttccgacggatttatattctacgacattagcaatgtacgaaatcctgcaaaatggcggcttaggaagcggcggattaaactttgacgcgaaggtcagaagatcttcttttgagcctgatgatctaatatatgcccatattgcagggatggatgcatttgcaagaggattgaaagttgcccataaattaatcgaagatcgtgtgtttgaagatgtgattcaacatcgttaccgcagctttactgaagggattggtcttgaaattatagaaggaagagctaatttccaaacacttgagcaatatgcgctaaatcataaatcaattaaaaacgaatctggaagacaggagcaattaaaagcgatattgaaccaatacattttagaagtataacaggataagctccagatcctgctatcaataccaagtcactgaattacccgtcatgattcctttcctattgcttgttgttatgacgggtaacttctataattaggatttatttagagtgaatggttttttaaaagggcaaggagtgaaaaaatgaagtatgtcattggaatagatcttggaacgagtgctgttaaaaccattttagttaatcaaaacggcaaggtttgtgcagaaacgtccaaaaggtacccgctcagccaagagagggcgggatgtagtgagcaaaatcctgaagactgggtgcagcaaacaattgaagcattggctgaattggtttctatatccaatgttcaagccaaggatattgacgggataagctattcgggacaaatgcatggattagtactgcttgaccaagatcgtcaggtgttacgtaatgcaattctttggaatgataccagaacaacgcctcaatgtataaggatgaccgagaaatttggcgatcatcttcttgacatcacaaaaaaccgtgttttagaagggtttacattacctaaaatgttatgggtaaaggaacatgaacctgaactttttaaaaaaactgctgtgtttttgcttccgaaagactacgtgcgattccgtatgaccggtgccattcacaccgaatactccgatgcagcaggaactttacttttacatattactcgcaaggaatggagcaatgatatttgcaatcaaattggtatttctgcagatatttgtcctccgcttgttgaatctcatgattgtgtaggatcgctgcttccgcacgttgccgcgaagaccgggctattagaaaaaacaaaagtgtacgctgggggagcagataatgcttgcggcgctattggagcaggtatcctttcttccggaaaaactttatgcagtattgggacctcaggggtcatactttcctacgaagaagaaaaagaaagagactttaaaggcaaagtccacttttttaatcatggaaaaaaggattctttttatacgatgggcgtcacgctcgctgcaggatacagcttggactggtttaaaagaacgtttgcaccaaacgaatcgtttgagcaattattgcagggggtggaagctattccgataggagccaatggactgctatacactccttatttggttggtgaaagaacgccgcatgctgattcttctattcggggaagcttgatcggaatggatggagcccacaatagaaagcactttttgagggcaataatggaaggtatcacattctctttacatgaatcaattgagctattccgcgaagcgggaaaatcagttcatactgttgtttctattggtgggggagctaaaaatgatacgtggctgcaaatgcaagctgatattttcaatacgagggtaattaagttagaaaatgaacaagggccagctatgggggctgcaatgctggctgcctttggaagcggatggtttgaatcccttgaagaatgtgcagagcagttcattcgtgaggctgctgcattttatccaaaggcgcaaaatgttcaaaaatataaaacactatttgatttgtataagaacatttatactcacacaaaggatctcaatcaagctttgaagagctttcgaaaaaactaatgatgttattgtctggagatcaaccgaagaacaattaatgatcaatcatcatcaaaggcctttgatgacatggctgccttcttttgaaaagatggtgagaataaggtatcgcaacctttaaacagtattggagtgtccagcagacaaaacgaacgagcggaaccgtattctgtcagcgaacacttcaagaagtgagaaagcttaggaatgccaatgggtaagatatatgaaactgtgctaacgacggtagagggatctcttgatttatgatgaaataggaaggatgtttacacacaaataaccccctcacattgacgtgaaggggtgttttttattgttactatacagtggaaattttacaggctagttgcatgattttagcttgataagcagaatggaaactagacacgccatcatctctttctaattctttggaaactgcattctgctaggtttgctgctttttttaacaaacagtgtttttctatttcacacagccattaaatcctctgttcgtcacataaccgctcttactccaaattgacagtttatctgactttgcttcttgctcatctagtctgaattggtctatgtattttgtgttaggctcatatacatatgctactctggccaatccctctttcaataatgtctcttgaacagatttgccgtcaacataaacgtatgctaacagtcttccatacttatctctgcgatcgcctttatcaaattccagctgtagcttaccgctgttgaccaattctttatttcgtttcgacgcatcctcaccgtatggttgaacacaagaatttggtttcttcgtctcaggtgtatcaacgagcaagtagcgaactgtgtctttctttccgttgtaaataaccttaatcgtatctccatctattgctctatctaatgtaacatcgatcaatttcttatgattttttgaatgaggcgtgccagccttttgttctgtctgactatattcattagattgagtatcttgagagacttgctccgtcccattagaatctgaatggtttttggctgcgtgatttgatccgcaagctgccaaagtaatacttaaaacgattgcgatcatactgatcaaaatcttcttcatattgattccctctttatcattttctctttttgcgattaaacatcatcattataacgatatggacattttttgtgaatggaaaacttcaagggaacttataacactccaaattgccaatagttaacttcacaacgagatgatcaaaacatcaccatcacatagcggaaataaataatcctgaaaataatattgactgaaaatgcttttagaattatgataatatgagaaatgacaataatgtgacaaaaacattactacaacataacaactaatagcttaggtttattctattggctaaaatgtaaacggttacaaatccagaggcgaaaatctaagatagagatgactttagttttgactcaatatccacactgaaagagcttattaagtattcttaataaaggcaggggaaatggatatgaatgaacatcgaaatcgaaggttgaaattaataatgatttcagcaacttttggagggcttctctttggatatgacaccggagttataaatggagctttaccttttatggcaaggccagatcagcttgatttaacaccggttacagaagggcttgttacgagtattcttttattaggagccgcgtttggagcgttgttatgcggaagattggctgatcgttatggccgccgtaaaatgatccttaatctttcctttttatttttcctggcatcactgggaacagcgttagcacctaatgttttcatcatggtggcctttcgttttttactggggctggctgttggaggagcctcggcgatggtgccggcctttttagcagaaatggcaccgcatgagaagagagggcgtatggtaagccaaaatgaactaatgattgttggcgggcaatttttagcatatgtttttaatgcgatcctcggtgtaacaatggcaaatacgggacatgtttggagatacatgcttgtcatttgtgctgtaccggctatcatgttatttgccagtatgcttaaggtaccagaaagcccccgatggctaatctccaaaggcaaaaacagtgaggcgctgcgagttcttaaacaaattcgagaagataaacgtgcagaagctgaatgtagagaaattcaagaagcggtagaaaaagatacagcactagaaaaggcatcactcaaggacttttctacaccatggctgcgccgtcttttatggattggaatcggtgttgccatagtgaatcaaattacaggtgtgaactcgattatgtattatggcacacaaatccttaaagaatctggttttggtacaaaagcggctttaatcgctaatattggaaatgggctgatatcagttattgcagttatatttgggatttggctggtcggaaaagtgagacggcgtccaatattattgattggtttggcggggacgactacagctctcctattgattgcgattttctcaattgtgcttgatggatctatggcacttccttatgtagtgctttctttgaccgttttatttcttgcctttatgcaagggtgtgtaggacctgtgacttggcttgtcatagcggaaatattccctcaaaggttaagaggacttggttctgggataagtgtttttttcctttggatattaaactttgtgatcggttttgctttcccgatcttgcttagctctgtaggtttgtcttttacattctttatatttgtggctttaggtgtattggcaatcggttttgtatacaaattcatgccggaaacaaaagggcgtacacttgaagaattagaagagcattttcgttctcgacacgatcataatactcctgaacaatcagttattgaggtataaatatgttgaaaatctctcttcttataggagggatttttttagtttcagaaaaaacaaaatccccctggtagagggatcttgattcagcattttaagatgttctatacgtataatactggagttgatactttaaaaatctcgccatctcttatataaaaacgagggatgcggcggcttaatgtagacacgacttcatagttaatcgtattgagcatttcagccacttcatcaacggaaatctcggctcctttttgcttaccgtaaatcacgacttcatctccttgtttaccttcaccgttttctcctaaactgaccatgatcatatccattgttactcttcccgccactggcactcgttttccgcgatgaagaacaaacccgcgattggaaagggcacgagaatagccgtcagcatagccaatcgggagtgtagcaattacttcattaggctctgcgacgtatgtagcaccatagctaacggttcggggttctgtccgcatggttttcacataagcgatgcgcgcctttaaacttaacgcaggttcaagcttaacgagatttagttgtttaatataggctgaaggatataaaccatataagccgatacctaaacggatcatatcagcgctaaattccggaaaagcgatagctgcagccgtgttgcacatatgcacggtgggcagctcaatcccctgtttttttaaaaagctgagaaaactgatgaatttttcgtgctgcagctttgtgagtgttgtgtccggttcatcagctgtcgaaaaatgtgtgaaaatccctgtccatctgaggaatttacttgcctttaaggctttcactacttctaaaagttcttcctttgtgcgtacacctaatcgtcccatgccggtatccacgttaatatgaatggccagccggttagcactcgcttctttttccaatatctcgtttgcttctttcatccaatcaacctggaatgctgataatgttatattccaagctgctgacttctttacacaactaagggatgtaaaaccaagcacaaggataggtgctgtaatcccagctttacgtaaaacgattccttcctccacactggcaacagcaagctcactcgccccgtgttccagtgcatggcgtgccacttctatagacccgtgaccataaccgttcgcttttacgacagccataattttgctcttatgtggaatatgacggcggatcgctcgcaaattctttttaacggcatcaagattgacttcgatccaaacttctcggcaaagctttatcatcaacgcttccttccttcttatggattataaataccacctattgccgcaagaataaatgttaattgttggatgattcgatcttattttattcaactttatttgaaatcattcaacagcaaatccatgtgatacgagaaggtgcctatcaatgttcgaataaaagcaagtacgggatacatgaggcttgtaagtggggtgttaatgggtacggcgaccgaggattacaaaaatgattatttgtttcgggacatttttttctaagggtagatgataacgagaaatctaatcaggaaaaacttaccgttgttatgaacattgaagaaccttttaaatgaggagggctgaggaaattctgtaaaagataatcggttgaaaaggcagtcgattccttgttccataaacctaacatcagagtatataattaaactcgtattcacaaaaatcgtttaagtaaggggtatacatgaataggggagttagttttaaataccgaatgaatatggaaattttctatggagaatactgcggccggtagaaatagctaattataggtggcaaacgagtggggaatcttattttgttgtagaaggagagctcgatgatgaggagctttttcatgactacgcaattgttgaaggggcagtttttgagcaacaattaaaaacgaatcagtactataccattttcgttgaactgaaagcatttccatatggaaaaatggttaatcaagtcaatacatatgaagagtttgctgacagtgattgcgaacttgtcctgttgatagcagataatagctacgtttcgatttactgtaaaaacaaaaaattcattgaaaaactttacttcaatgctttacagaatgattttgaagacgttcaatttatcactgatgaaaatgacacaagaacaagccttactgtatgatagtcaataaaaattaaaggagctagtacatgacaatgaaaattaaaatcaagtatctagatgaaacacaaacaagaatcagcaaaattgagcagggagactggattgatcttcgggcagctgaagatgtaacaatcaaaaaagatgaatttaagcttgtcccattaggtgttgcaatggaactgcctgaaggttacgaagcacatgtcgtccctcgttcaagtacatataagaactttggcgttattcaaacaaattcaatgggtgttatcgatgagtcatataagggagacaacgatttctggttctttcccgcttatgcattgcgtgatactgaaattaagaagggtgatcgtatctgccagtttagaatcatgaagaaaatgccggcggttgaattggttgaagtcgagcatttgggaaacgaggatagaggaggactcggttcaacaggtacgaagtaaacaaaataaatccttggctgtcttcatgctgtgtgattgatcaatggaggtttcagccaaggtacatataaatattatgtataaaatgaatattttaatacgaaggatttaattaaaaacaaattttaaaaagggaagttttgaaaaagtgaaatagtaataactaaagtcgataaagaacctaaagatgtcaaagaaacaatttttctggtgctttgcttttttgaaggtttacttagctcgtggataactgcgccccataaaagcatggatgctaaaattataatacttatatacatatagatgctccttttattatatttacagtttttacattttattgattttaccactttaggattgagttgtcgatgaaacaagcatctctataaagaaatacttttatctaaatttttataagtaggggaaggcaactaaaaactagtaatgccactaataataagccaagttaaatgacttgtgttcattaataattgaatttacagcagccatgagcacaaaaaaatctgagtatcgtcgataaatatcataaaaaagcccccggtatgtcgccggggaataaatagacgtttaagagatttagtgatgttttttatatgattcgacaaaatcataataataatgatcatcgtcatcataatactttttttcgtaatgataatcgtgatcatcgtaatactttttatcatggtcatcatactttttgtcgtaatcataatgttttttatcatgatcataatacttgtcgcaatcataatgcttcttatcattgtcgtaatactttttgtaatatgtttttttccaagtgtaatactcttctttatattttttataataacccaattaaattcctcctttatgttattcgaatttaatttatgaagtttaaatgatatggtatggtcaaatgaaataagaatagtaaaaagaggctgtttaaaacactttctgaaaaacaaaacggatagctgtttattaaaacaaaagcgagagaaagcactcaaccactgtaaaataatagtaaagtgtatagagaagattaatatacgtaaagagggactttctctaattgaagaatatttgaacgttatggttaagattcagagctctatgatgtgattttttaacactgcttttgaaggatttaaagttagacatcaaaaacaaacagcaaaaccggtcagaaacagatcatataaggaatgaaccgctgccaaatatcataaaaaagttgttaatgatcaaatgaatgaaattagagagaatttattttaaagaaagcccaattgcacatggacaaatgacaattgatattgaggtaaaatacaatgcattaaatcagaaaaagctattggaggatttaatgtgtttagacaatttccaatttggtatacacaaacacctaactatttgaatttttatgtgccgcaatatcaaaccatttcttataatcctcaacaatgttatcaacggtgtatgtaccaaactggcggtaactatgagctatgtgacagactatgttatggagaaatacaggtgtaaaagaggggggattaactcctctttaaacacacagtgagtggaataagatcctcactttatctgcaagtgcttagtatttgcgataatattgcattcgtaataaattatgcttagcaactgaaaatgaaagaaggatatgaatagtcatgacgcaattcgataaacaatacaattcaattataaaggatattatcaataatggaatctcagacgaagagtttgatgtaagaaccaagtgggactcagatggaacaccggcacatactctaagtgtaatgagtaagcaaatgagattcgacaactcagaggttccgattttaacgacaaaaaaggttgcctggaaaacagccattaaagagttgctctggatttggcagctgaaatctaatgatgttaatgatttaaacaagatgggcgtacatatttgggatcagtggaaacaagaagacggcaccatcggacatgcatatggatttcagctggggaagaaaaacagaagtctaaacggagaaaaagtggatcaggtagactatcttcttcatcaattgaagaacaacccgtcttcacgcagacatattacaatgctgtggaatcctgatgatttagacgcaatgtccttaacgccatgtgtatacgagacacaatggtacgttaaacatgggaaactccaccttgaggtaagagcacggagcaatgatatggcattaggaaatcccttcaatgtattccagtacaatgtgttgcagcgcatgattgctcaagtgactggttatgagcttggtgaatatatctttaacattggggattgccatgtgtacacacgtcatatagacaatttgaaaattcaaatggaaagagaacagtttgaagcacctgaactatggatcaatcctgaagtgaaagatttttataactttaccattgatgatttcaagttaatcaactataaacatggggacaagcttttatttgaggtagcggtttaatgctgcctttttattgtgcagtgaatggatagcaggtatcctaatttcattaagcaatctggaagatgaataaaaatcgaaggacaaacacgtataatacataaaaaagattaactctacagttaatcttttttattcagaagaaaatatcctaactttgaaactaaatacaaagtaaaagcaatcattatagttctagatattacaattccatgaatagctagatcatatccagcaggtactaacgcatttgtattacacataaaatatatagatattagaagtgctacaataactaaaatcattccaaaaagacttgttttttcatatttcataccaatttccacccttattaaagttaggtttaaacaaaagagctgaagaaacgaactatgaccagtatgctccaatgaaaaccgccagacaatgctggcggatttttgctgcttcgtttatttattaacagagatcgtaacgttatttcctgcaacagaaacctttgcgaaatcctgtgtatctaccacaggagtgacggctttattgtcgattgtgatgttgttaaaagatgtcgaaaaggttgctttgatcgcatcacgctggctttcatacgaaacagccgcggtagcaagggttttccattttgaaatcgtgccgatgttggttccttgaatttctgtgataatccgtccggtgtagccgtcattgttcgttccccaaagggtcatgcgcgtattgccgcttaaatttttatggattgtcatttggactgtgcttccagggcggaagcctttattgtatgtgaatttgtcttttccttcgatgtacgtttcttcatttttggacccaaccttcatgaggggcttccagacgttgtattgtttgctgtactgaagcccgatatcggcctcagttccgcttgttgccctaaatcctgaataaatataaggagtagagaccgtatcatattttacagtgtcaggaagattgattttagctgtaaaaacggcgcctgtactattcagataggcgcggccgccgattcccttaggcagctgtgatgctgcttttgcgacttgagcatctgccgcgggtaagcctggtatacctgatgaaagggttccgaaaagaaccgctgttcctactgcacctgcaatcaatacttttttcaccaaaattcccccttttgatagtggtttggccatttattataccttattttggaactgtattgatgtatataatcgacaaaatatttcattttgagtgaagtaagggacgaaacgcttcgccaatctgaaagctatatacctttatcagaggaaagaatgagatcacaatcgttttaaccgatttgaaattctcctcaaaataaaagtacaaatgcttaaagaaacgattattaaaagaatgcccgctatcgtttccctgcctgtaaaaaagaggtgacgtttcatcaatgtctgtccttgtaaaatgataaaagcacagataccgactaagaaaagaaaacaaatacttaggattgctaacgctttacgtgagtatgttttcatttcatctttaaaatacagcaatacgaaaacaaagcagataacattggctattgtgcttatcacctcaaagcttttcatgacaactgatataaatagacaaagtaaaatgagataaaatacgatgtttctatacaaaaaacctctccttttatgtatgatcctcaaagagtttataaaagtttctttgtaactgcaataaactgaatgcgctcacttatgaactaactaaactatgtactaaatattcactattctttttcagattcagtcaccaaggttttcatataaagggaagcttcagaaatatacatatagtgcacaaacaaaaaagacccggcaatagccgggggaaagtaaaaacgaggagatgttaatggcgtttagtagtgttttttatgctttttatactctacaacataatcatagtcttttttatcgtgatcataatattttttatcatagtcatcgtattttttgtcgtaatcacagtcatcatattttttatcatattcgtaatacttcttataatacgtttttttgaccgtataatactcttctttgtattttttgtaataacccatatatactcctcctttatttttactacgctttattatacggcgagtagattttgcggcttggacagttaaaatcatagaaggaaaaaagggctgtccaaatgatagaaaaagacagatgacacaaaaacaaatcaaaataaagagccgatttttcatcggcccaaacgatttatcctacatttgtttgtcttctttgttttctgagtcattttttctgatatcctgagtcagtccgcttgttgcttgtttaaattctgataaggcttttcctgctgcacggccaagcgccggcagtttatcaggcccaaatactaaaaaacccacaaacaaaataacgagtatttttgtgaagcttaattccatatccttttccccctgattgaagtacaaccttttaaacaaattataagagatagcagtacaaatgggaatgcatttattttgaacattttaaaaccagacaaagacggattcataaaacggctgctgctgaatataatgtccaatgccacctgcctaagaagcagggaggcaggctggatcaattatgtagctctgccggaaatgatacaaacgtatctgcggctatcattgaaatagaggagtggtgtagttgatgagattcactaaggtagttggatttttgtctgttttagggttggctgcggtttttccattaacggcacaagcagaaaaagccggaactgcgggggctggagagtgggataagttggggacttacacatatacttactcaagtccgacggtatactcgaccggaggagattttagagtttgcctttcaggaagcactcctttttctgtttcactgcacttatatgaggatgatcccggtgacaatcctgatgattatgtaggggcaaactatttttcacccggagaatgccacacatttggcagtattggaaaatttgtagatgggagcaataacaaggccgagttctttgttaccgattactctggtaaatctaaaactgttacgttttatgattgatggactcaaattgtgaagtataacccttgggaaagaacaaaaaagagagatacctctctctttttttattcttcgacagccttacgaagccgttcatttacaatgccagtccagccgccatccatcttaccgcgaacgacggagcttttctcgtttgctttgccgatcacttcattcggctctttccagccgctgtgaataagggtaaaccctgtcttttcccccaagtcttctaattgaaaggtaacgacccatccttctgtatcccattcaaaagaaagttcagttggagcttgaacagccaaaactttacaaggggacggcccaaacggcgattgtaagtgaaattcttgtccttctttgagctgaaagtcattgggcataaaccacttggcaatgccttctgaagtagagactgtctcccagactttctgaatgggagcctccagagtaatgctttttgtaatatccggtaatgcattttcgttgttttgagccatttcgtttacctcttgacatatgatgttttttcaattcaatcatataataactaataagatcatgtccatagcgtgcattatttatgctagagctgctgttgaacagcgtgtcagtcgccagtctgatctgtgaatgggagaattctgcatgcgcgaaaaagagagagaggtgtatgttgtcatttcgttcattcttgtttgcagccgcaactgctatgtttgaaccggaattcctgttcaggcaatttattttgcgatttttgttttaatagtaaatgatccattttctaaaacaggaggttttttatgcttggaaaaatcaaagcagccattgataacagtccagggaagccggccagaattttagttagtgaaaaagcgtttcagcaattagaggaggaaatgcgctttgtttacgtttccaaaccgaaaacgataatggggattcctgtggaagtttcagatcaggcagaaagcttcaagctggaattttagttttcccagactgctaaaaggctcattttgtgttaattatgcaaaatggtcaggttgatttctttaaaagcatgatgaaatgttcatcatgctttttttattgagaaaaaagacgaacataaaaaataggtatacgggaaaaataatcctattagagagaggggaaatgacagatggataacatgatatcaacacttactgactggaatgtgtggtttcaagcgttagtagtatttctcgttccatatgtaatctataaagtgtttacttggattcatgtataagaaggtgcaatgatgaggtggcggaacaatcagtacaaaacacagaagcagcataaatcagattattcgacagctgaaaagcaggatcaggatgtgttaaccggtaacatcggatgcgatttagaacatgtaaaaagaaaaataggacataacggggacgttcacttccgtgagcttgaaatcactcatttacatgtgaaagcggcattgatctttgttgaaggactgtctgatcaggacttgattaataaaggactatcagtgttagtcatgaatcaacctaatcaggtaagcgatgaaatttctcaatccggcaaaggtattttaacttcgaaacagataaaaaatcaaatcgtatcaatcggtgatgtcatagaatcagagaaaatcagtgatatcgtgttgaatgttttcatgggttcgacagcgcttctcattgatggaataccgcaggcctttcttctgggaactgtaaaaaaacaaaatcgaagtatcgaggagccgctttcagaagcgcttgtcagagggccgcgcacaggctttacagaagagttgagtacgaatacagctcttttgagacagcaaggaaaaaatgatcaattaacattgcagagatttgaagtaggaacacgattaaaaaaggatttaatcatcgcttatatgaatgacattgcagatccaaaagtagtcgaggaagtaagaaaaagagtgagagggattgagatcgatcatttgccggagtcaggctacgttgaacagttaattgaggataattatttgagcccgttcccgcaagtacagagtacagaacgtcctgatcgcgtcataagcggattaatggaaggaagagtagccattctgcttgacggcactccgtttgctttgattgttccagtcactttcagcatgatgcttcaatcgcctgaagattattatgaacggtggttcccgagctcgctcatcagattgctgaggttcatcgcagcaatgataacgttattcgcacccgctttatatatatcatttatttcttttcatccggggttaattccgaccaagctggcgatttcaatttccgggacgcgccaaggtgttccgttcccatcccttattgaagccttatttatggaagtcgcgatcgaaattttaagagaggcggggcttcgtctgccaaaaccgattggacccgcaattggcatagttggcggattaatcatcggggaagcagctgtgcaggcggggattgtcagtccaatcatggtcattgttgttgcgctcacagcaatttcttcatttgccatcccgcattatagcacaggtatagcacttcggatgcttcggtttggcgcgatgttttgtgcggcggtgtttggattgtttggagtcattatgtattatctgctgctaagcagccatgtcgtaaagttaaagagctttggtgtgccatacgcaagtccggcagtgccctatcacttaaaagattggaaagactttgttatcagaatgcctcttttagtcatgaagcgccggcctaaaatgatgaatacagataatacaaaacgggtgaagtgatgaactcgacaggatggtgataaagtctcatgttcagcccaaccagtaaaatcacaaccgctcaggcaacgattatcatcattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctggcagcagttttttactgcaaaatgtggttgcggccaatggagcggtcaagtattccggagcagctgtaatcaacggaaaatcgaaaaaaatgataggcactttaaatgaatatgaaactgagggaattacatggattagaggagaagggaaaggcggagttgtcaaaagccatgataaaaagagccaacaaacgatagcgtacgatatcaataaaattaaaagcaaaattcagccaatcgtaaaagggaaaaatatttcattccatgtcgatattgaatcagaaggcgatttggttgaaaactggaacacaaaagaggcgttggacacccagtttatagatcgtctcgaaacgactattgaaaacgaagtaaagaaaatagttggtcaggtattaaaaaaaattcagcgtgattataaagcagatgttgcgggttttgatgaatctttaagacttacatatccccacttatggaaaagggtgaaaaataactgggatgacaccttcagtaaagccgacatcacatacagtgtgaacgtcacaattactcatttcggcacggttaaaactcagtaatgaatcccaaggaagagaaggaaacctctcttctcttttttatgcatttattaggataaagatactttttttggagagatatacacttttcaaatcgaccaatatgctaatataggaattgcttgaaatagaagggagaaggggctgtgaggcagaaaccgatttatgtagaaatcgaaatgaaatctgatctggatacactctgggaatatacacaaaacccatcactgcataaggaatgggatctccggttttcaaatattacgtatttgaatagtcagccatgcgaaaaacagaagtttctttacgaaacaagggtaggctttggattaaaggtgtcaggtacaggagaaaccgtccgtgttttcaacaaatgttcatctgaaaggtcttcttcactggcttttggctctgatcatccattatctctgattcggcatggaagcggctactggaagtatatacagagagaaaatgggaaaatgacgtttttaacacagtaccaatacaaaacagcctacggactgctgggaagatggattgatcgtttattatttcggccgctgcttggctgggcgactgcctggagctttgatgcattaaggctttgggtagagcaaaataaacatccgaagcgcttcattcgatctgctatcatctatgtgttcatgtgtctgtttttcagcctgttttggttctatcaaggctttgcaggtgttgaaacaagcattttggcaggaacagcggagataggcttagctattttgtggctgcttcctttaaaaagaaaatggatcattcatggtgtccaggcttgtatttttgctgggtttgcttgtctaggttccgaaatattcatgtggattctgttgagtgtgttttccgctgcaagcggcgctcttagcctgcagctccccagtgccaggcgcacaaaacgaaagagaaagaagtgacattgtgagttcgatttatgaaaaatcaattattaactatcatttgctgcatcccaagctgcggaaacggtaccaattagacgggtctcaaacattcagcgggacgggaacgatgtcagaaataagcggaggctcttttctggttagaatgctgttaaagctgggtgtttttttcagatgcttcttttcagaaagaggcaaagacattccatttacaatacaaaatagaacttgtcttttgaaatcacaacatacaggaatagaatggaatcgtacatttatctttaaaggcaaaaaacgtttctttgacgcgataatgatatatgacgagaaagaaaatagaatacttgatttcttcggcaaacctcatctgctgctgtctgttttgacgttcgaggcatctcatgacggctctcttacgatcacatcgggaaagcaatggctattgatatgcggaaaaagaatcccgttgccgaaatggctgaccggtacatccgtagtttgcgaaacgtttgatgaaaaaaagaattgtttcaccattgaagtgcatgtaaaaaatacaattcttggcactcttttcttttataaaggaacgtttcaggaggaagagagagaatcatgaaacgaaatggcatagtcagtgcgctttgttttataggatttcttgcagcggaagcactggatatttcagtggcagaggcactcgttttgttatccattcttttttttgtgccgggaattttcccttttgtttttcgtcaatcgccggttcgtgctgctcagtttatggaatatgggctaatccagtgctatccggcagccgcattctttgcggtgctggctctagtgacggaggttggaggtttcgcgctaatctggtggatgtacacagtttttattgcattgtatgcgatcctccgcctttgggaaacaaagatacatagaatcgaagagacatcaggtttgttcggtcttatttatttggcgggaggaggattttggttttttgcttatgctgcccatttgcagatcatgcaatttggccctctcatcattttgctgactgctgtccactttcactattctgcttttctgatcccgatcttcaacggcttactcggcagaaccattagaaaacatcggatgttgtatagttggataacatgggtgattttgctttcgccccttcttatcgcactgggcatcacatattcaaaaacacttgatgtcattgcggttagcatttatatggcggcgatttattttcatgcatttttggtgttcacggcagcttttcgcaccaagacggcgacatttcttattcgggtttcttccgctgttttaatgataacgattgctttctcgatgatttattcatttggtgtatttcggcaagaagttacattgaccatcaatcagatgatttggattcacggttttgtcaacgcgtttggtgttatcttgcccgctctcatagggtggagaatagaggatccgaagtcttttgatgcagacagtgtaaagacattcagccgtatctacggaaaaagaaagattggagaagaatttttagctagaattcaagctgaaaataacgctcggtacagcggacttgtggatgatatgggcagcctgcgttcaaaagatttttcaccagaaaaactggcgccgctcattctttcgttttatgaacaaaccatcgaatacaatattaaagcaaaagtaacatggagcacgtggtttcggccgcttgcaattgtttacgaatggttcagcagaagaatcggccaaatacatctttcgacgaaccctgactggtataggatgtacagcaagataaaaggtgttcattcgaaaaaagacggaagggaaagagtacgtgcctggattagaacaaatgaaaaaaacgaaaccatttttaccgctctttattcagtgtatcgttcaaatggagaggggtatatgaatatttctttaccgcttccattcagcagcatgacaggtattttaaagccatatcatcatcaggagaagctggttttaacaagcaggcggagaaaaagcagagcgggtgatgaggggatttatctgcaaacaagagcgggaacttgtccgcttcctttatctgaaacctttctgatagaagctgcacatgacaacaaattaacggctgttcatcatatgtggctgtttggaataaaatttctaactgttcattacagcattacacatattaaccagcctattgaaagaacctaacacaaagaagaagcttcgtctgccagttgtaatagatgaactgtttttaaaaaattctgctccgcatcaagacaggaaaggaagggtttatggtgttttatatcagtttatttctgattctttggctggctgcggggtttgcagtgggaatgaaacaagtgtatgtcgatcagctgtttgataaagctgtgatcgaaaggctgtaaaaagaagcgaatgatcatggacacgctgaccgaatgatcaaacagcgcgtcctttatattgcagcagtgacattaagcgggtttatttctgtttattatgaaatgaaaacaatcccgcaaaggcgaaacataagaaaaattgaaaaaaacatcatgaaattaaatcaagcaaaaaaacgaagaatgaagagaaaataaaaaatgcacaggccaaagggcaggtgcatttttgttttgtatggaaatgggggaggtggtgccagcttacttttcataaattcaaaaatgagaagaacagcgcccgggctaatggtatataatattgtgaatttaacaaaaatttaacaaggaggacgagagaattcgtgctaaagcctcaaagagacctacatcctgttgatttggacttagaggcggagtagatgaaaccggccaaagtatccctgctccgccgtttgctccattccttgaagcatgttgattgtaacatagccaaacgttttccatcaactattaaaattgtaaaattattgtttatttttatggtatttactccgatttcttcaatttatgctgaagatatatatcagaattttgaggaattaaaaaacaatgaagatccttctgattacgacattgttacgaaagaaaccggaagccctgttcttgttttagctattcacggaggaggtattgaaggcgggacaagtgaagtagcgagagagctcagcaaagagtactcgatgtatttatttgaaggcttaaaatcggcaggaaactcagtcctgcacattacgagcacgcactttgatgaacctcgggcccttaaaatgacgggaaatcatgaatatgtcatttcattacacgggtacgcagaagaagatcagcagatcgaagtcggcggtacagatcgcgtaagagcggcagatttagttgagaaattgcagcatgctggttttcctgctgtattgctcaatacggaccatccgcatgcgggcgttagtccgaataacattgcaaataaatcaaaaacaggtttaagtatccagatagaaatgagcacaggctttagaaagtctttgttcggcatcttttctttaaaaagcagagctgttactcaaaatgagaggttttataagtttacagaagtgatgttccgttttctcaaaaatagctactgaaaaataggaggcgataagacagcctcctattccttatgtttctctttcgtttcgggaaatagctcgtccgcggcttccgtttgatactgcaacgtgttatctctcgctgacagttcatttcggaaattttcatcaagcacatttttcagtaaataccgatgaaaaaagtattcaaaaacagtaagacaggcagcggaaaggagagctgctccaaatggtgagaaatcgtttcttgtttgggttaaaacaaatacccaaagaataacgaatgaaaggccaaagtcagccaatgaagctgtaatattgtttgttctgggtaagacgagcatgtcaccagaaagataggaaacaaaacctaagaaaagtgcaataaacatcacacttaaaaaggatgcgtgatagactctgtccaaaatcacatataaaagggcgagagtgaaagcaatctttgaagcaagcgcaatgatatgtttcatttgaccacctaaattgttattttttgaagaaaattcttgggcgtaaacaaatgataaataatgcaattcaaaaccattcataatggtcatgttactattttaaacagtccgtttttgtttacactggtattttttttcagcagtatgaaactttcttatgaaaaaagacgtatatgtggatgatcagctttcaaggggggaatgatttgtggagataaaaggaatcaatcacttgttattttcagtttcgcatttggatacatcgattgatttttatcaaaaagtgtttgatgcaaagcttttggtaaagggaagaacaactgcatattttgacatgaacggcatctggctagcgcttaatgaagaaccagacatcccgagaaatgacattaagctttcttatacccatattgcttttacaattgaagatcatgaatttgaggaggtatcagctaaattaaaaagacttcatgtcaatattctgcctggcagagaacgagatgaacgcgatcgaaaatcaatttattttaccgaccctgacggccacaaatttgaatttcataccggaacccttcaagacaggcttcgatattacaaacaagaaaaaacccatatgcacttttatgatgaaacggccttttgatatcacacaccatatttcatataaggttaaatttaaagaagggtgttggtggagactttatgttttgggaaggtttctacccgattagttcaacgatgccatatcttttgaactgcacaagtgattcggtgaaggagaatttgaaatacatattacattttatatgaagaaagcgagctgttttaacagaatgttgaactacctaaactatgtactaaattttcagttatatcaattgcctcgccctttaataaatataaaaccgcatccttccacgacctaaaaaatgaaacgtttttaagaagatagcgtctaatattctaaacgttcatattttgaataaaagtttcctgaaggaaagaaaatttcttgacttcaacaattgtttggtggataattatggtgtaaacatgatgttctttttcctcctattcaggctcgcacccaaaagtcagggcgagcctgctttttttgaacaacaaaccccctctccgtaaaggaaaagggggttatttcatgcatctgatagatcaatagattaatggacggttctgaacacgcctatcactttccctagaatgctgacattctgcaaaatgataggttccatcgttgggttctcaggctgcaagcgaatgtgtgtatcctctttatagaatcgttttacagttgcttcatcatcttctgtcatcgcaactacaatttccccattgttcgctgtgttttgctgtttaacgatgacatagtccttatcgagaataccagcatctatcatactgtctcccataatctccagcataaatacatgctcgtctggaggaaccatgcggtcagggagcggaaaatattcttcaatattttctactgcagtaataggagatcccgccgtgactttcccgatgactggtacattaacgacctggctttgcggaatgtctacttcttcatcaagaatttctattgctcttggttttgtcggatcccgtctgatcagcccttttgtttccaagcgggccaaatggccgtggacagtagagctggacgcaagcccgacagcctctccgatctctctcacggatggcggatatccttttgatttaacctctgctttaataaaacggaggatatcaagttgcctttttgatagcttcgtcatttttcgcacctcaaaacgtcgattttaagaagattatagcatgattttccttacagtacaaacataggttcgaaaaaacaattgacagaaacgtttgttcgtatatactgaaattataaaaatgcgaacaaacattcctgttggaggttatgatcatgagtaaagaatctattatttttgtcggtctgttcacagtgattttgagcgcggttatccttatgctgtcatatacaagcagcggccaagagcttaatcagtatgttaaaatagaagtccagcaaggcgacacactctggtcaattgctgatcaggtagccgatacaaaaaagataaacaaaaatgattttattgaatgggtagctgataaaaatcaacttcaaacctctgatatccagccgggtgatgagttagtgatcccattgaaaaagaagcatcaggatgcatatgaattagcaactgtaagatagagaggaaagagagataaaatgaaagcactcatttatgcccgtgtaagcacaaataaagaacagcaggaaacgtcattaaagcggcaggaggaggagcttacggccattgcagcggagaacggcatggaagtggtcaaagtgatttcagaaaaagccagcggctatgaaatggatcgggatggtgtatttgagctgcttgatgagattaagaacgctggaattgatgtcattttggttcaggatgagactaggctcggacggggaaacgcaaaaatcgcactgcttcattgtatttatagagaaggtgtgaaagtctatacaacggctcatagaggtgaactggagttatcggaggctgactcaatggtcttggaaatcgtcagcattgtggaagagtatcagcgaaagattcacaacatgaaaatcagacggggaatgaaacgtgcagtaaaaaacggttttaaaccgcaaaaaaacttaaaaaaccaacatgggaacagtggaaaagaaaaaatagaggtgccaatctcagagatcgtccgcctgagagcgaataaactgacgtttgctgaaatcgcggctaccctaagagggtttggctatgatgtctctaaagcaaccgttcaccggcgttttcaggaatacatagagaatgaagagacagcagagtgaatcagttgtaaaactttttttgatctagtactatatagacaaaatgcaataaaggagtttaacatgatttcaaacgcgaaaattgccagaattaatgaacttgctgccaaagctaaagctggcgttattacagaagaagaaaaagccgaacagcaaaagctccgtcaagagtacttgaaaggttttcgttcttctatgaagaacacgttaaaaagtgtgaaaatcattgacccagaaggcaatgatgttacaccagaaaagctaaaaagagaacaaagaaataacaaacttcactaatataagaggaatacggcaatatcgtattcctcttttgcatatactataatcaaaactcttatgtgacaaaattcaacaagtttctctcaaatttaagctgaaacagttgagaaaaagtcgtcagacatttatgatgtaagggtacaacacataaggaaggggatttttatggatacaattgaaaaaaaatcagttgctaccattcgcacactgtcaatagacgctattgaaaaagcaaattctggtcacccagggatgccgatgggagccgctccaatggcatacacgctgtggacaaaatttatgaacgtaagtccggcaaaccctggctggtttaaccgtgaccgttttgttttatctgctggacacgggtcagcactattatacagcatgcttcatttaagcgggtttgatcttagtattgaagatcttaagggattccgccagtggggcagcaaaacaccaggacatccggaattcggacatactgccggtgttgatgctacaacaggtccgcttggccaaggaattgccatggcagtcggtatggcaattgctgaacgccatttagcggaaacatacaaccgcgattcatttaatgtagtcgatcattatacatacagtatttgcggtgatggtgatttaatggaaggtatttcttctgaagccgcttcactcgcaggccatcttcagcttggccgtctgatcgtactatacgattctaatgacatctctcttgatggagacctcgaccgttcattctctgaaaacgtgaaacagcgttttgaagcaatgaattgggaagttctttatgttgaggatggaaacaatattgaagaattaacagcggctatcgaaaaagcacgccaaaatgaaaagaaacctacattaattgaagtgaaaacgacaatcggattcggttcacctaaccgtgccggtacatccggtgttcacggtgcgccgcttggtaaagaagaaagcaaattaacaaaagaagcttacgcgtggacatatgaagaagacttctacgttccgtcagaagtttatgagcatttcgctgcagctgttaaagaatcaggtgagaaaaaagaacaagaatggaatgctcaattcgctaaatataaagaagtttatcctgaacttgctgaacagcttgaactggcaatcaaaggagagcttccgaaggactgggatcaagaggttcctgtgtatgaaaaaggaagcagcttggcatcccgtgcatcttccggtgaagttctcaacggacttgcgaaaaaaattcctttctttgtcggaggttctgctgacctagcgggatcgaacaaaacgactattaaaaatgccggtgattttacagcggttgattactcaggcaaaaacttctggtttggtgtacgtgaatttgcgatgggtgcagccttaaacggtatggcgcttcatggcggtcttcgtgtattcggcggaactttctttgtcttctctgattacctgcgtcctgcgattcgccttgcagcgttaatgggccttcctgtgacatatgtcttcacacatgacagtattgcggttggtgaagacggtccgacgcacgagcctgttgaacagcttgcttcactccgtgcgatgcctaacctttctttgatccgtccagcagacggcaatgagacagcagcagcatggaagcttgcagtgcaaagcactgaccacccaacagcgctagtgcttacacgtcaaaaccttcctaccatcgatcaaacatctgaagaagcattggcaggagtagaaaaaggtgcatatgtcgtttctaaatctaaaaacgaaacacctgacgctcttctcatcgcttccggatcagaggtaggtcttgcaattgaagcgcaggctgaattggcaaaagaaaacatcgatgtttctgttgtcagcatgccttcaatggaccgttttgagaaacaatctgatgaatacaaaaacgaagtccttcctgcagatgtgaaaaaacgtcttgcaattgaaatgggctcatcatttggatggggcaaatacacggggcttgaaggtgacgttctcggcatagaccgattcggtgcatctgctcctggtgaaaccatcattaacgaatacggcttctcagttccgaacgtagtgaatcgagttaaggcattaatcaataagtaagcttttgaaagaggatgagtcaaatcatcctctttttcttgtttatccgacaaaaatagtattggctgtttaacagtaatagacaattctttcttttcttcttttgtataatagagagcaaatgaaatgctgctggaaaaggggatgaaaagatggaacgtcactactatacgtacctgatcaaagaggaatttgccaatcactatttcggccgggaatcggttatgtttgagctgtttcaagactatcattggacaagccttgaaaagcagcagtatgaaatgacagagaaacagattcaatatattacacaaccaatcccgattttacatatgcatcagcggttaaaaatgaatttaaacaagacggattacaggcagctggattatatttatagaatagctttgccgaaagcaaaaggccacgcgacgtttatgatgaaggagcacatgatagaaattgtggcttcgggagattacgaggcagaaacgatattctttgaagtgttaagaaaagtaagcccttgctttttagcaatggatttcaattcgaagcgttacggatggctaaatccggtgaaagaaagaaattttgtctaaaaccgaagaaaaagagatgtaaatgttgtataatagcttttggtttagtacactttaaactagacaacatgaaggaggaaataaaatgactttatgggttggcatcctagtgggcgttgttgcattgctcataggtgttgcactcgggttttttattgctcgtaaatatatgatgagctacctgaaaaagaatccgcctattaatgaacaaatgttacgcatgatgatgatgcaaatgggaatgaaaccttctcaaaagaaaatcaatcaaatgatgaaagccatgaataatcaaacgaaataatacgtaaagattatgatatagagaaacatggttataaaataaaaaacccttatacgggttttttattttgcaatcattcatcacccgctactgctcgaaggcgctgcttttgatattgtatgagaagatggtcaagctcctgactgagctctatcgtaatatgagatgtcattccgttcgccatgacaatttgcagcagctctgctctttttttttcaatttcttttaatagatgctctctaatcacagggatgtatcctttcatacattagatcttcaaagtgaatgtttatattatatccatatttatactaattttcaaatgagaaggagtataatgtctcaatgtcaaattaaattatataagttttttctgaaaatagaaatccttcaagtgaaagtgttaaaaaaatgaaatgattttgtcataacttgaaggaatgtcaaatcatgaagggatgatgacatgggagacgtgaattatgttttgacattcggtgcggggtttttatcctttatttcgccttgctgcctgccgctttacccagcttttttgtcatatattacaggggtcagcatggacgatgtaaaaacagaaaagctgctgctgcagaaaagaagcctgtttcatactttgtgttttttgcttggtttttcagtcatttttattgctttaggctatggaacatcttttattggcagcctgtttagggattatcacgatgcgattcggcaaattggcgcgttgcttattattttgttcggtttcattacactcggtgtgtttcggcctgaggctatgatgaaagagcggagaatccattttaagcataaaccaagcgggtttttagggtcggtcttaatcggaatggcatttgcagctggatggacaccatgtaccggtccgatattaggtgctgttatcacacttgcaggcaccaatccgggttcagcggtgccatacatgatattatatgtactcggttttgcggtaccgtttcttttattgtctttttttatcacaaagctgaagtggataaggaagaaccagcttttcattatgaaagctggcggcgttttgatgattgtgattggtgtgctgttattctttaattggatgagcctgatcattattttgctgtcagatctttttggaggctttactggtttttgacggtaaattactttcgtactactactaatccttttgtttttggtacaataagactattatctgtggaaatcgattgttggaggggaatatgacaagagttttagttgtagacgacgccaagttcatgagagtgaaaatcagagagatcttggaagatgcaaattacataatcgcaggcgaagcggcggacggtgaacaagcagcggacctgtataaaaaactgcgaccggaccttgtgacaatggatattacaatgccggtgaaaaacggcataaaagcgcttcgtgatatcttaacctttgatcctaaagcgaaggtcatcatgtgcaccgccatgcgccagcaaagaattgtaacggaagcaattgagctgggggcaaaggattttattgttaagccgtttgaggaaacaaaagtgctggaagctgtaagccgcgttatgggacattaaagtcatttcttttcaaaatggttttttttattgttttggagtatagtatatagtatcaacactccgagaaacaaaggaatgataagtatgatgattatagtttcatcgattattgctgtgttaatggctgtagctgtgatggtggtcagaataaagtcctctgacaagcctgtttcaccaaaaaaaatcattcttccgccgatttttatgagtacgggagcgttaatgtttttatttccggtattttgggtaactggtgcagagtttttggaagcattcactttaggtgtgattttctctatttttctaatcaaaacttctaagttcgaaattaaaaataatgaaatttacatgaaacgctctaaagcatttgtttttatattagtcggtcttttggtgatcagaatcgtgatgaaatccatcttgagcacatcaatcgattatggtgcactgagcggaatgttttggattctggctttcggtatgattgtgccttggagaatcgccatgtatttatcatatcgaaaacttcataacgagctgcagtcatctaatattcaaatgaattaaaaaacctttcctcttgtcaggaaaggttttttatttgagaagggtctgataaggttccaaatcgatttttttgtcccgcagatgcctttttaagaaggtatggtctcttttaggagttgcgagaatatagcctttgatcataagttgctgatcaatctttgctaccttttcttttaatgcaagctcaccgattttgcctgcgattttagcttttgctgcatctctgaacagctctggcacgggcgcagtcaattcatctagaaactgtttgttttcatcgttccataaatgtctgctgttttcaatatagtaatcctgccaatcaagctctgatctgccgtcctcttttggtaaacgctttaaaaactttcgaaacatgaaaaaaccgccgattgataataagactaccatcatgatcacccaaaacagaataaaccataaaaaccatccttccagcatcaatcattcccccttattctaaccatattgtatacgaagagagattagaagaacacagtaaaaaaagaatagaaaaaagtgatagacgtctagtcaaaagagatagtagatcatattctattgtatagtgaatctgctatttggccatgggagagtcactagagggtatttgacgataaatggacggaaaaaaagtcactttcataataggggatgaaagtgactttttatgtttagctgagaggaaattgaagagaaaaagaagagccatcttctgtttctttattgacggcgactgtgagtatttgattttcgcattcggcttgaatgtttttgtcattaaaataaaaaggaagcatcatttgtttttcaaaagtctgtcctgacgatttgacagttaagatgaactcgcatccagaaagggtaactgttacttgtgtaggctgtaaaaaagtcagatccgcttctataatatactgctgacttgtttcatataaatcaataggcaatgtttcgtcgtaccaggcgaaggggtcttcaaaaaattgccgaagccattcatccatactatcgaaatcattcgcatcgttgcgttttgaatggttcatggaagcattcctccacatatcaaccttgctttacatcatatgcggtggattataaatgggtgaacgcataaaaaaacagacactaaggtctgcttttcttacatatcatggcttgagttgtgcttttgtcttgtatggtttcggttctttacttttttgcttccgcttagaggctcaggttggccgggattgtgtcctttaggggcgtttttatgcatatctttacttgtattcttattggtcataaaatgagaacctccttaaaagagttcggtgttattgattggtttttctttttttgttattttggcgttctgcttcagtcagtacaagctggtcgttttcaatatagccggcgcctttgccttggctttttgcgtcattcattccgttaatgacgtgattcgcttttcttttgaccatcattatcacctcaatcataatatggcttcttttattgtgttatatgagagagcgtaaacagtaaaaattaccggtacatttttctcataagtcgaacttattgtatttaataaaaacattgatatttacttatgtatgattttgttttaatatgaaattgtgagaaaattgtgatggaatgtaatgttcatctgagaatgatctgatctgaagggggattttggagaatggcaaacgagcaaaaaactgcagcaaaagacgttttccaagcgagaaaaacgtttactacaaatgggaaaacatatcattactactctttaaaagcgttagaagattcaggtataggaaaggtttcgaagcttccttattccatcaaagttcttttagaatcagtattgcgtcaagttgacggcttcgttatcaaaaaagaacacgtggaaaatttggcaaaatggggaactgccgaattaaaggatatcgacgttccgttcaaaccgtctcgagttattttacaagacttcacaggggttccggcagtagtagatctggcttcactgcgtaaagcaatggcagctgtcggcggagatcctgataaaatcaaccctgaaattcctgttgatctcgttatcgaccactctgtacaggtagataaagcgggtacagaagatgcattagcagtaaatatggacttggaattcgaaagaaatgcagagcgctacaaatttttaagctgggcaaagaaagcgtttaataattatcaggcagtgccgcctgcaacaggtattgtgcaccaggtcaaccttgagttcttggcaagtgttgtccatgccattgaagaagacggcgagcttgtaacgtatcctgatacgcttgtcggaacagactcacacacaacaatgattaacggtatcggtgttctcggctggggtgtcggtggaattgaagctgaagcgggaatgcttggacagccttcttacttcccagttccagaggtaatcggcgcgaaacttgtcggcaagcttccaaacggaacaacagctactgacttggcgttaaaagtaacacaagtgctgcgtgaaaaaggcgttgtcggtaaatttgttgaattcttcggaccgggaattgctgaactgccgcttgcagatcgcgcaactattgcgaatatggctccggaatacggtgctacatgcggattcttcccagtagatgaagaagcgcttaactacctgcgcctgactggccgtgatcctgaacatattgatgttgttgaagcatactgcagaagcaatggcttgttctacactccagatgcggaagaccctcaatttactgatgtggttgaaattgacctgtctcaaattgaagcaaacttatcgggtccaaagcgtcctcaggatttgatcccgctatctgctatgcaggaaacgtttaaaaagcaattagtcagccctgcaggtaaccaaggattcggtttaaatgctgaggaagaaaataaagaaattaagtttaaactccttaacggcgaagaaacagttatgaaaacgggtgcgatcgccattgctgcgattacaagctgtacaaatacatcaaacccatacgttctgatcggcgccggactggtagcgaaaaaagcggttgagttagggcttaaggtgcctaattacgtgaaaacgtcacttgcaccgggttctaaagttgttacaggatatcttgtgaattcaggccttcttccatacatgaaagagcttggctttaacctcgttggctacggttgtacaacatgtatcgggaactcaggtccgctttcaccggaaatcgaagaagcggttgcgaaaaatgatcttctgattacgtctgtcctttccggaaaccgtaactttgaaggacgtattcacccgcttgttaaaggcaactatcttgcttcaccgccgcttgttgtggcatatgcgctggctggaacggtaaacattaacttgaaaaccgatccaatcggtgtgggcaaggatggtcaaaacgtatactttaatgatatttggccgtcaatggacgaaatcaatgcacttgttaagcaaactgttacgccagagctattccgcaaagagtatgaaacagtatttgatgacaacaagcgctggaacgaaattgaaacaacagatgaagcattatataaatgggatagcgagtcaacttacattcaaaatccgccattcttcgaagaaatgtctgttgagccaggcaaggttgaaccattaaaaggtttgcgtgttgtcggtaaattcggcgattcagtcacaactgaccatatttctcctgcgggggcaatcggaaaagatacgcctgccggaaagtatttgcaagaaaaaggtgtttctcctcgtgactttaactcctacggttcccgccgcggaaaccatgaagtcatgatgagaggaacatttgcaaacattcgcatcaaaaaccaaattgcaccgggtacagaaggcggatttacaacgtactggccgactggtgaagtaacatccatctatgatgcgtgcatgaaatacaaagaagataaaactggtcttgttgtattagcaggaaaagactatggtatgggatcttcacgtgactgggctgcaaaaggaacaaaccttctcggcatcagaacggtcattgcagagagcttcgaaagaattcacagaagcaaccttgtattcatgggtgtgctgccgcttcagtttaaacaaggtgaaaatgcggatacactcggcttaacgggtaaagaagtcattgaggtagatgttgatgaaacagttcgtcctcgtgaccttgtaactgtaagagcaatcaatgaagacggcaatgtaacaacttttgaagcagtcgtccgctttgatagtgaagttgaaattgattactaccgccatggcggcatccttcaaatggtgcttcgtgaaaaaatgaagcagtcctgatgaatcaataggaagagaaggcatttcgctttctcttctttttatgacacaatgtgctgcggaggtggcatatgctgaaaaaatggctcgcagggatcctgcttatcatgcttgccggttatacgggatggaatttatatcaaacatacagcaaaaaagaagtcggaattcaagaggggaaacaagcacctgatttttctttgaaaacgctgtcaggagagaaaagctctttacaggatgcaaaaggcaaaaaagtgctgctcaatttttgggcaacttggtgtaaaccgtgccgtcaggaaatgcctgcgatggaaaagctgcaaaaagagtacgccgacaaacttgcggttgttgcggtaaatttcacttcagctgagaaaagtgagaaacaggtccgagcgtttgctgatacgtatgatttaacattccccattctgattgataaaaaagggatcaatgctgactataacgtgatgtcatatccaacgacatatatcttagatgaaaaaggtgttatccaagacatacacgttggcaccatgacaaaaaaagaaatggaacgaaaactggatcttgattagattcagttttttttatgctcagatatgcttacaagttttcagaattggaaaaaataaaagaatatgcggaggtgagaagcgtgaagaagatgagaaaacgttcttttcatgagctcgtcatggaaaacaaaaaagagctgatgaccaatacagagtatttaaatcagcttgaggaaaagcttgaacagcgatttaagcaaaaataacctttaatttgtattcatgtttacccctccttttgagaaacctatctgttgaggagggataaacatgggaaacaacaagaaaaacggtcagcctcaatatgctccaagccacttgggtacaaagcctgtaaaatataaagccaataaaggggaaaaaatgcatgatacttcaggacagcggccgattatcatgcagacaaaaggcgagtagcgaaaattcgagtttatttctaggaggtacatccgaatgacaaagaaccaaaatcaatatcagcagcctaatcctgatgatcgttctgacaatgtggaaaaattgcaggatatggttcaaaatacaattgaaaatatagaagaagcagaagcatcaatggagtttgcttcaggagaagataaacagcgtatcaaagaaaaaaatgcaaggcgcgaacagagcattgaagcgtttcgtaatgaaatacaggacgaatctgcagcgagacaaaacggataccgttcttaaaaaaccagggaaacctggtttttttctttctgatttgattatggtaaaatggggctaaattgacgttaagggagcagagtaatcttgcatgtatcaaaaaaagaaatagaagtgcgttatgcagaaacagatcaaatggggattgtctatcacgcaaattatcttgtgtggatggaggtcggcagaacggccttgattaaggacttaggctttttatatagtgatatggaaaaaaaaggcattctgtccccagtcgttgatatcaatatttcctataaaaagccgcttcattacggagaaaccgcggttgtacatacatggatagaggaatataacggctttaaaaccgtctatggttatcacatttataatccggccggtgagctttccatcaaagccacctcatctcatatttgtgtggataaagaaagctttaagccaattcaattccgcaaagcttttcctgattggcacacatcatatgaaaaggccaaaaaatagggaagtgaatgggatatggcgtttggtgtgaaacgggaggaacttaaccggtggaaacaagcagtgaaaagaggagaaatcgcatttttaacacattactggctggatgaccgatttccagaagcaaagactgtgacaaaagccggatgtgcagacattgataagctggttcagtggggagcggcgtacgggttaaaaaaagaatggatccataagaaaagtgaatttcctcactttgatctgctgggtgaaacacaaaaatatgttttggaacaagaaaacctaaccgatcatcttatacgatttcatttgtaaaaaaagaacgcacatgaagtgcgttcttttttattggtattcaaaaaccggttcatcagcgtcttctgaatagctgacgagaaggtcgtggttatcgaagtaccataaatcactttcttcaataaagaaggtaatgccgtcagcttctgcagtgactccagcctcttgtggggcatctttcgctacaccgagagaaaaacccttttgaacgttgctgcagcctccatagcggacgaaaaagcgaacctggtctccgctttccaaatcgagttcttctttataccagttcaatgcgtcttcgttaattgtcatattcataacagaacacccctttgttcttcatttgaattttctctattataaacgtattaggctattctgtgtcaaaagagaagttttttaagcttataaccattttactttaggttctgttttattgataattcgtttaatgttcgctcggtgtctgtatatcacaaaaatagtgagcagggtaacgacaatcaataaatacgtatcatggacaaagaaactatatataacagtatagatccctgttaacatcgatgagagagaaacaaatttagtcaagtataaaaagatgaagaataccgcaaccatcgtgataaataacaggggtgcgtaaaatagcaaaacgcctcctgatgtcgccacggctttaccgcctttaaatttggcgaagatgggaaacacgtggcctaaaaccgcaaagactcctgcaagaagcgggtgaatatcaacatgcatgagaaaaggcaatgcagttgccagtgtccctttcaaaatatctccggctatgacgaccgaaccagcttttacacccaatgtacggaatgcattggtagcgcctaagttgccgcttccgtgctcccgaatatcaattcccttggcaagcttgcccacaattaagccagacggaatgctgcctatcaagtaggccaaaataatcaataaagcaattaacatctacatttctcctttttcaaattcccttctttttattttaacatgagatgtcatgatctgatgataagtttttttgtaaagtttgcttacaaatccaatcaaacatgcatcatattttgatttctcctgttttgatcgtgtaaaataagtggaaaaggagtgacacacgatgcaaaatccttctaaagcggaaattaaagagattcttcaaagaagcaaacgtatagcggtagtagggctttcagaccgtccggatagaacgtcacatatggtttcaaaagcaatgcaggacgcgggttatgaaattatccctgtgaaccctacaattgatgaggcgctaggtatcaaagccgtttcatctttaaaagagatagacggtccgattgacatcgtaaatgtattccggcgatcagaacagcttcctggagtggcggaagagtttttagagacagatgcgccagtattttgggcacagcaagggctagttaatgaggaagcataccagatgctaaaagaaaaaggcagaacggttatcatggatctgtgcataaaagtggcacacgctgtaacaaaataggtgcagaactgcaaaaatccttgtaaattcaaggatttttgctttttaattttaagatattgtttgcgtattacggtgaaacagatacaataaagcttgaacagctttttttgaataccttgtccagctgggtttcggccgttcgatttgcgaaggtctgctgctttatatataataaacaaacatacgttctcatagtgtaaaaacagcactagccgatgttttgagaagaactgattcgttagctctatgttgcgattgcaaacatattggttataatgaggagtccaaggcagtactggctcgaggcgaggtttataaaaaatatcttatatacaaatgatgtgtaacactgaaaagagaaagacaatgttagtttttgaaaggggtttgtacgtttggctagaaaacagcaatttgattacaacgaagatgccatacaggtgctcgaaggccttgaggctgtcaggaaaaggccgggtatgtatattggctctactgacgcgcggggtttgcaccacttggtttatgaaattgtagataactctgtcgacgaggtgcttgccggccatggagatcacataatcgtcaaaatacataaagacaatagtatttctgtacaggatagaggccgcggcatgccgaccggaatgcataagctcggcaaaccaacccctgaagtgattttaacggtgcttcatgccggaggaaaattcggccaaggcggctataagacaagcggcgggctccacggagttggtgcatcagtcgtgaatgctttatctgaatggctgacggttaccattgagcgggacggttttgtctatcagcagcgatttgaaaatggaggaaaaccggttacatctctcgaaaagatcggcaaaacaaaaaagacgggaactcttacacactttaagccagatccaacgatgttcagcacaaccacttataattttgaaacgctctctgagcgcttaagagagtctgcgtttttgttaaaaggattgaaaattgagctgattgatgaacgcaatgaccagcatgaggtcttttattatgaaaacggcatagaagcgtttgttgcttatttaaatgaagaaaaagacgtcttgtctgaagtggtctcgtttgagggtgagcatcattctatagaagtggactttgcgttccagtttaacgatggttattctgaaaatattttgtcgtttgtcaacaatgtcagaacaaaagacggcgggacacatgagtcaggtgcaaaaactgcgatgacgcgtgcttttaatgaatatgcgcgaaaagtggctttgctgaaagaaaaggataagaaccttgaaggcaccgatataagggaagggctttcagccattatttctgtccgcatacctgaggagcttcttcaatttgagggacaaacaaaaggaaagctcggtaccagtgaagcaagatcagcggtggatgcgattgtttcagagcagcttgcttactttttagaggaaaatcgggacaccgcaacgcttcttgtcaaaaaagcaatcaaggcgagccaggcgcgcgaagcggcacgcaaagcccgtgaagaagcaagaagcggcaaaaaacgaaaaaaatcagaagcgactttaagcggaaagctgacgcctgcgggttcaagaaacccggcaaaaaatgaattgtatctcgttgagggagattcagcaggcgggtcagccaagcagggacgagaccgcagattccaggcggttctgcctttacgcggtaaagtcattaatacagaaaaagctaagcttgctgatatctttaaaaatgaagagatcaatacgatcattcatgcgatcggcgggggagtcggggcagatttctcaatcgatgacatcaactacgacaaaatcatcattatgaccgatgccgatactgacggcgcccatattcaagtgctgcttcttacctttttctatcgctatatgaaaccgctcattgagcatggcaaggtgttcattgcgctgccacctttatataaggtcagtaaaggaagcgggaagaaggaaatcattgaatatgcatggtctgatgaagagatgggtgatgtcctgaaaaaagtcggcaaaggctataccattcaacgatataagggtcttggagagatgaacgcagaccagttgtgggaaacgacgatgaatccggagtcccgcacacttgttagggtcaaaattgacgatgcggcacgtgtagaaagacgtgtgacgacgttaatgggagacaaagtagagccgcgcagaaagtggattgagaaaaacgtcgcttttggcttagatgaagaaagcaatatcttagaaaatgaaaacttatcggtcgctgaggaggtttaatgattgtcacagccagaattatttcatgatttaccattagaagaggtgatcggcgaccgttttggacgctacagtaaatatattattcaagacagggcgctgcccgatgcaagagacggattaaagccggtacagcgcagaattctgtatgcgatgcatacagatggaaacacgtttgataaaaacttcagaaaagcggccaaaacggtcggtaacgtcatcggtaactatcatccgcacggtgacagctcggtttatgaagcaatggtgcggatgagccaggattggaaagttcgtaatgtgttaatcgaaatgcatggaaacaatggaagtatcgacggagatcccccggcagccatgcgttatacagaggcacgattatctccgattgcatctgagcttcttcgggatattgacaaaaacacggttgaatttgtgccgaactttgatgacacaagcaaggagcctgtcgtactcccggcgatgtttcctaacctattggtcaacggatctaccgggatttcagcaggatacgcgaccgacattccccctcatcatctgggagaagtcattgatgctgtcattaagcgtattcaaatgccttcttgctctgttgacgaactcatggaagttattaaagggcctgattttccgacaggcggtattattcagggcgttgacgggataagaaaagcttacgaaaccggaaaaggaaaaatcattatccgcggaaaggctgaaattgaaacaatcagaggcggacgagaacaaattgtcattactgaaattccatttgaagtaaataaagcaaaccttgtaaaaaaaatggacgagttccgtattgataaaaaggttgaaggcatctcagaggttcgtgatgaaacggatcgaacagggctgagagtggtcattgaactgaaaaaagaagctgatgccaaaggtattttgaatttcttatacaaaaatactgatttgcagatcacatataacttcaatatggtagctatccataaccgccgtccgatgctgatgagcttgccgtctattttggatgcatatatcggacaccaaaaggaagttgtcacaaatcggtccgtttatgagcttcaaaaagcaaaagacagacatcatatcgtagaagggctcatgaaagctttgtctattttagatgaagtgattgcaacaatccgttcttctagcgataaacgtgacgctaaaaacaatttgatcgcgaaatatgaatttacggagcctcaggctgaagccatcgtgtcattgcagctatatcgtttaaccaatacagatattacagcgcttaaggaagaggcagaagagctcggtaaaaaaattgaagagctcgaatctattctgagcaatgataaaaaactgctaaaagtgattacaaacagcttaaaagcactgaaaaagaaatatgcagatacgagacgctccgtgattgaagaaaaaattgaagaaattaaaatcaatctcgaagtcatggttgcatctgaggatgtatatgtaaccgttacgaaggatggttacctaaaacggacgagccagcgctcatttgccgcttccaacggacaggacttcggaatgaaagatacggacaggatgctgcatcagtttgaaatgaatacgacagacgtgctgctgctctttacgaacaaaggaagctacatctattgtcctgttcaccagctgcctgatatcagatggaaggacatgggccagcatttttcaaatctgatcactattgaccgtgatgaaacgattgtaaaggccataccgataaaagaatttgatccgtcggcatatcttctattctttacgaaaaacgggatggtgaaaaagacagagctcacccattataaagcacagcgttattctaaggcgcttgtggccttaaatctgaagggtgaagatgaactgattgatgtacatgtaacaaatggggaaagccagatctttatggccactcacttagggtacggtctatggtttggagaagacgaagtgaatgtagttggcgcgcgtgcggcaggtgtcaaagggattaacttaaaagaggatgactttgttgtctccggtgagatccttcagcaatctgattcaattgtcttgttcacacagcggggagcggtaaaacgcatgagtctttctgagttcgagaagacatcccgcgcaaaacgcggtgtcgtaatgctaagggaactgaaaaagaatcctcaccgagttgtagcactgttcgcttgcggtcttgaacagcgactaatggcagaaacagaaaaaggcgacagaaaagaactgcaggcaaaagagttgcggacaaacgacagatacagcaatggctctttcttttttgatgaagaggaatcaggcaaggttacagctgtttggcgccttcatacagaacaataataaaaaacccgctcatactatatgagcgggtttcgtttgttttttatcagctttcatggttggtgaatagatctgttaccgcatgaatgacttcaattccctgccatacaaataaatttagcgctgtgaaagagaataagcctaaaatcaccattcttaagataaacaacatgttaaacagcctcctcatattttcgttacataatcgggtgatgttgaacatgaagtttgccgaaataagacgattgataaaatttggccagtataaagctttttttccgctgacgtctgcgggagtatcccgtacttttgctttcagcggtcagcagcagaacagccattgcccataaagcggtcagtgtaaatgcccctgtgatggatttcttctcatcatcagcattttggccggctttcatttcatgcatttcctgctggtcggctacggctttataatgatgaccgatatcaaaggcgtggggaattgagagcaaatgaaaactggcaatcgccaagaataagatggatgctttcaatatcgttacttttttcaaatgatctccccctcctttaatattactgaatatttttataataataccccaatccatcctaaaagtaaacctgatttattaaatttaaaaataaatttaactttgttaagtatatatctttttgcttatttttgaaagagaaaacttcttttattagcgtatgtatacccggtttatggtgtgaataaaaacatattttaaatgatatgtttgttgtttaggatttattactttatttatgtgtaaatcaaagagaaaggcaagagaatgggaagaaatgattacattgttaatagggtactctttttttaaagccagtttgcaaggaatgtttttattcgtaggaaaataatagagaaggggtcgacagagtaacatctggctacgacaatattcttctcgaaaaaacttcctaattcgtcatattgtgatataataaaactcgttatgttaaaaaatctaacatcaaaatcgaattcgtattgaattgatgaaaacgggaggtaaatatggagtcttttttcaatagtttgattaatattccaagtgatttcatctggaaatacctattttatattttaatagggcttggattattttttaccatacgttttggttttatccaattccgttattttattgaaatgttcagaatagtaggggagaagccggaaggaaataaaggtgtttcatctatgcaggcattctttatttcggccgcatcccgagtcggcacagggaatttgactggtgtagccttagcaattgcgacaggcggaccaggcgctgtattttggatgtgggtagtagctgcagtaggcatggcttcaagctttgttgagagtacgttagcgcagctttataaggtgagagacggggaggatttccgcggaggcccggcttactatattcaaaagggtcttggtgccagatggcttggcatcgtttttgcaatcttaattactgtctcattcggcttgatttttaacgctgttcaaacaaatacaattgctggagcattggatggcgcattccatgtgaataaaatagttgtagccatagttctggcggttttaactgcgtttatcattttcggcggtttaaaacgtgttgtcgctgtttcacagttaattgtgccggttatggcaggcatttatattcttatcgctttatttgttgtcatcacgaatattacggctttccctggcgttatcgctacaattgttaaaaatgctttaggttttgaacaagtcgtcggcggcggaataggcggcatcatcgttatcggtgcgcaacgcggacttttttcaaacgaagcaggaatggggagcgcaccaaacgcggctgcgacggctcatgtatcccatccggcaaagcaaggctttattcaaacattaggcgtatttttcgatacatttatcatatgtacgtccacagcatttattattttgctgtacagtgtaacgccaaaaggcgacggcatccaagtcacacaggctgctcttaaccatcatattggaggctgggcgccgactttcatcgcagtcgcaatgttcttgtttgcattcagttcagttgtcggcaactattattatggcgagacaaacattgaatttattaaaacaagcaaaacatggctgaacatttaccgtatcgctgtaattgctatggttgtgtatggatctttatcaggcttccaaatcgtttgggatatggcggacctctttatgggtatcatggcgctgatcaacttaattgtgattacgctgctgtcaaacgttgcctacaaagtgtataaagattacgcgaaacagcgtaaacaaggacttgatcctgtattcaaagcgaaaaacatcccagggctgaaaaacgctgaaacatgggaagatgagaaacaagaagtataatataaatataaaacaaagctgcattcaatagttgaatgcagctttttcattatttgaaataaatttaatttttcgactcgaatgaaaaatgacgtgtaaagtcccaattcagtccagttttctttgttctatatgtgtcatgtgtgtcttattcattggaggtagagcaaattgacaggcttttaaacctccaaaaaacaagaaattaggttgatagacaatcatgagaaagatttttacaatgagttcgtgctcataagaagtgtagagccaaaatgatgcgaaggaggaaaagatcagatatgaaacggtcaatctctatttttattacgtgtttattgattacgttattgacaatgggcggcatgatagcttcgccggcatcagcagcagggacaaaaacgccagtagccaagaatggccagcttagcataaaaggtacacagctcgttaaccgagacggtaaagcggtacagctgaaggggatcagttcacacggattgcaatggtatggagaatatgtcaataaagacagcttaaaatggctgagagatgattggggtatcaccgttttccgtgcagcgatgtatacggcagatggcggttatattgacaacccgtccgtgaaaaataaagtaaaagaagcggttgaagcggcaaaagagcttgggatatatgtcatcattgactggcatatcttaaatgacggtaatccaaaccaaaataaagagaaggcaaaagaattcttcaaggaaatgtcaagcctttacggaaacacgccaaacgtcatttatgaaattgcaaacgaaccaaacggtgatgtgaactggaagcgtgatattaaaccatatgcggaagaagtgatttcagttatccgcaaaaatgatccagacaacatcatcattgtcggaaccggtacatggagccaggatgtgaatgatgctgccgatgaccagctaaaagatgcaaacgttatgtacgcacttcatttttatgccggcacacacggccaatttttacgggataaagcaaactatgcactcagcaaaggagcacctatttttgtgacagagtggggaacaagcgacgcgtctggcaatggcggtgtattccttgatcaatcgagggaatggctgaaatatctcgacagcaagaccatcagctgggtgaactggaatctttctgataagcaggaatcatcctcagctttaaagccgggggcatctaaaacaggcggctggcggttgtcagatttatctgcttcaggaacattcgttagagaaaacattctcggcaccaaagatgcgacgaaggacattcctgaaacgccagcaaaagataaacccacacaggaaaacggtatttctgtacaatacagagcaggggatgggagtatgaacagcaaccaaatccgtccgcagcttcaaataaaaaataacggcaataccacggttgatttaaaagatgtcactgcccgttactggtataaagcgaaaaacaaaggccaaaacgttgactgtgactacgcgcagattggatgcggcaatgtgacacacaagtttgtgacgttgcataaaccaaagcaaggtgcagatacctatctggaacttgggtttaaaaacggaacgctgggaccgggagcaagcacagggaatattcagcttcgtcttcacaatgatgactggagcaattatgcacaaagcggcgattattcctttttcaaatcaaatacgtttaaaacaacgaaaaaaatcacattatatgatcaaggaaaactgatttggggaacagaaccaaattagttaagctttttttggcggacatcagtaacgatgtccgtttttatcatctaataggaggtttgcgttgtggatgaaatactgaaacagtatatggtgctgtacaaaaaaatgagtaatatgataaatggtccggactatccaggtaaggaaaaagacatccagcatcaaaaagatcagatcgaagtttacgaaaaacagttgcagcaaggattttctacagattatgactatgatgtgtttgctgattctgttatcaaatgcgcatatggcgatatgacgctggaggatttagaagccgtttattatggattgacaacgccatttttttgatttgtcattcagcagaaaaattttaattcctgtctcactaacttaagtatacttttatattgagacaggaatttatttattttctttacttcctagaatatatattatgtaaactagaaaagatgaagattaaagctttgctgtttttatgtacatcctttcttcttcctgtaattcagcaacaaaataaaaaagcgatttcccaatcggaaaatcgccaattcagacactctattatttatgtgtgtctttgtgctcttaacgatttacaacaaatgttgttacgctttgagctggaagatgggcccaaaaatgattgcctgatacagtgagattcgttccaggttgtagattgctgctgctgctcgtgatccatctagatacgtttgaagcagatccattctgcaaaacaaagttttggttgactcctgtgttgcttttattgatggcaacaataacgaccttgttgtcacctttataggctgacacgtaaacgttcgcattagggtttttcgttgcatcaatccttacatagccgggacgcacaaactttgagaaatgagccatattgtagccgcgtttgctgatcgtaccatcttctttcataggtccatatgatcttcggatgtaccaccatacataagcttgaaagtccccctctaccatcgcattgtgaatatgctgtgaaacatccaatgcctcaggccatcgatccgccgagttgttatcactgtttggatagtatacttccgtcatccaaaggtccttccccgctcctttttgtttgaaaagaggataagggaattggctgacctgggtgccgtacaggtgagttccgagaatatccatattggcaagagcctgcggatcgttcaagatcgggtccgacaaattctttaagtattgaaaagactcaggtgcaatgacgcgggcattgatcgagccggcgttttctctcataaagcgaagtatttcttgcggcgtccaccacgtccactcgtgagcgtaatcaggctcgttttggaccgaaatcgcataaagattcacaccattatttttcatgaaggtaacaaaatcgttaagatgctgcgcgtatgcggcgtacttatcgtatttcagccgcttagctgatgtgtcaccattccgattgaaggtctcaaccatatcacttggaggattccagggagatgcaaaaacgattgccccatgtttgaccgcactcttggcagtctccacctctttataccaattatttcgattttcatctacatgaattcttaagattgaaaatcctaactggttctgttcattgccaaaagcagtttctctttgagctgctgtaagatccccagcccaagccggatggttcatccctccaaaaccgcgaatcacttgtttctctgcagatacattaactgttacatcactggctgccaaaacttcagtagcgcctggccctaacatgactgacagcatagtgaaacatactaatagtacacaaattgttttttttatgcgtggaatcatttattcctctccttcgtcatgtgtcttttacggtattaaaaaatctgtatggcatatccataatggcgggctgttccggtgatggctcgtacttcacccgcctcgtttttaagcggtcccattacgagtcctatctttgcgtaaactgccagtaatcaaaatgaaacaagtttcctgtacctgttccggtaaatacaaagaatactttgtgcacacctgttgccccgcttactgcagtttctatttctctccacgtttgcgctccgcctgttgaaggcacattcagagttccaacaagcttaccatcagcactgtcgaggcgcacttctattttcccgcctgaacctgaagtggatgctacatttgctttaaatgacctggcaccgcccgctccgaagtctgcatttcctacagcaatccagtctccattttgaatgcttgttacatgctgattatttactggcccgccgggtgctgtggacttctctgtcaaaatgcgtccattccaagcaaacgtttcagcttctacccggttataaggattcaaattggaaagctgtgttacacctgcataatttgctgctacctcttggatggatccatctgggttatgcaccagcttattaatatggggagaacggtatcctttgccggccccgaacagagcggaactgacagtttgcgcgtggtacaccacataccactcgtttttaaaattgaaaacagcatgatgattgtttccgccacctccgaaaaatgcacccggatttttcaggaaatgccctctatatgtaaagggacccatgggatttgaactggtcatgtagccgatctcacccgggggtttatcggccgggtgcgtgccgccgaaattaatgcaataggagtaataatatgttccgttatacttgtgcaatcccgaatcttcaaacatgaaaggcgcatcaattgtagatgcacttccaacaacactcgtcatatcaggccccaattttatgactctagccgttttaggattggcccattgtccctgcgttggatttgaaccgccaggaacgcctcccccggcatacaggtaaccggtgccgtcatcatctacaaatactgccggatcaaaaagccatacaacaccagacattcctggcgtacttggcgttacgagcggttttccgattggatcggtccatggaccaatcgggctgtctgcggtgagaaccccgatacctccgccgctgtttgcgaaataaaggaagaatttatccttgccattgattttttttactgcgattgacggtgcccatgacgcccctgcccattttgctatcccacggccaccattagctccattggcacctgctactggaatggctccgtggtctgtccagttcaccatatccgctgaagaaatgacgaatactttattcaaattggcaaatgaattatctttaatcgttccgttgctattatattcatagtcatcacttgacatataaatatagactctcccgttataggtcagcgcaatcggatctgcgcccaaatgatggtcgataagcgggtttgaattccctacatgttttgcaattgtactactggtggcagcatacgcagactttccagataaacagcccaatagtaaagcaaaaacaaataaacatacgctacactttttcctcatcacttaacagcctcctttttccttaaaatgaagggttcttttgaaatttgttaacaacaggtcatgaagactgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagttcccccattcctagcggtcattgtccagaaaataaaatggcgaattgttcaagtcccctataacgcttgagcaggtatgtatatttattcaaaaaaatccctttatctaacatcctaccttattaaaaaaatagtgtatagaatacttttggaggaattcgtgttcgattctacaaaggaactggatacatttattcattgtttagatggggctannnnnnnnnnnnnnnnnnnnnnnnnnnnnnnnnaaaaatcagccgttcatgccgctgctttttaaagagtataaaaactattgagcggtatacccgcttttttcatgttttgttcatattttattaattgtttattcaacactgtccgctatagtaatccatatcaacaaatatgactgccactcgcatcttttatgaagggaggtccgttacgctgaaagaaaaaataaagaccttaggccgtttttgcaccgtaggcgtcggcaatacgctgatagattttggtgtcttctttcttcttaccgcttgtcatgtctcttatctgccggcgcagatctgctcctatactgcaggtatcgtcaacagctatgtgtggaaccggaattggacgttttgtgtcaaacgtaaggctgacgggaaagagatcgtgcgttttctcatgattaatattgccgcgtcggggatcacctttttgctgctttatttgtttcaaaattgcggctgctcgcttttggtgagtaagctcgccgccactatcggcggaatgatgatgaattttatcggaaaccgaatctgggtatttggagattcactgaaaaacatacaggatcaggagtgaggatgaatgagaaaaaaagtgagaaaagcagttattcccgcagcgggtttaggaacgagatttctgccggcgacaaaggcgcagcctaaagaaatgctcccaatcgtcgacaaaccagcaatccaatatattgtagaagaggccgcagagtcaggaattgaagatatactgattattacagggagaaacaaacgctcgattgaagatcattttgatcggtcggcggaattggaattcaatctccgggaaaaaggcaagacggagacacttaaggaaatgcagcagattgccgatttggccaacattcattacatccgccagaaagaaccgctcggattaggccatgcggtgctgtgtgcggagcattttatcggagatgagccttttgctgttctcttaggtgatgatattatggtgtctgaaacaccggctcttcggcaattaatggatgtatatgacgtttatggcacagaggttgtcggtgtacagtcagttctccctgaggatgtcagcaaatatggtattataaatacatcagggtctcaagggcatgtatatgaagtgaacgatttagtggaaaagccttctcctgaagaagcaccttcggaaatcgcagtaatgggacgttatgtgctgaattcttcgatcttctccgttttgaagacaattggcagaggcgcgggcaacgaaattcagctgacagatgcgcttcgtgaggtttgccgtaaggagccgatccatgcccggctgctggaaggaaatcgatatgacattggcgataagctgggctgttttaaagcgagcaccgaaatcggcttaatgcgtcccgaaatgagatctcagcttttggcctatttagaagatgtgatcaaacgggaaacgaaagaaatgctgcggtaaaaaaattgtaaccatcttgctcgtcaatcagtcatataatagtgaaaaagattaggacaggttgtgaagaatgtgggcagtttgataagcgaaattttaacatggctgacgaacatgggatatgcgggtattgcgattgggttaatgattgaaatcattccgagtgagattgtattagcttatggcggctatatggtatcggagggcacgattggatttattggcgcaattattgcgggtgttatcgggggcaccattgcccagatctttatttactggatcggccgctatggcggcaggccatttctggacaaatacgggaagtatttattgattaaaaagcatcatatcgacatgtcggaaaactggtttcagaaatacggcgccggagttgtcttctcggctcgttttataccggttgtcagacatgccatatccattccggcaggtattgccagaatgccttttctcaaatttgtggtactgactgtgcttgctatcattccatggtctattctgtttgtttatttaggcatacagctaggaagccagtgggatgatgttgagaatatagcgggcacttatacaacaccgattatgatattggctgttgtcgtgatagccctttattttgtgattaagaaacgtacagccatatttaaacgatagctagcagatatgcataggggtgactgacgctcccctatgcatatttttttacttccgatgttgatttgccagcttcagattctccgctaaaaatgcgacaaacacttcatcccgcacgagcgatgcggcataatttctcttaataaaccattctgcctcttcaaacgctgcgaatgtttcgtcttgggtttctccgttaatttgaatattccattcgttgtctaaagggaaaagaaaaaatctcatttgtgcgcgattttcatataatgatccattcgcagatccctttagattatagatgttacggaaggcatccggccgtacaggatcaatgcggaaagcttcagctacaaacaactcgtatacttcatcggttattgaacagccggacgcttttgcatgccctccgccgccatatcggccggcgatttctgacacatcgatgtaatcatgaatggtgcggagactgactcgttttgaccccatgctcaaaatcgcaatgtaatcgaggtgcgggttatctttccctagcctgttccccagctctgaatggtacgattcagcgtgaacgatgcctacacagtgttcgtgaacaaaagtttgtaccatttcccttttctttctgcggaggtagcgctcgattttttcgtcttctaaatcaagcagtttttcttcaaaatcatcgaagaaaaattcgtcatgcgcggaaaggcgctggatcatttttgcttcaaattcatcgattgacagcaaaaagaaaagatcattaagccgctttgcctgtttttgatcgtaccgctcccactcccatgtatcgtattggcggacgagctctgtgaattgatctaaggcgtttgtcggtttcatgaagccattttcaacgagatagccatataaaagcgatgtcgcggatgtgagccttccatcatcgtattccacctggacaaatccccattcatgctcattcaaatgaagggctgttttatgatggtcaatgagcttcactttgccccctgtatgaacatactcattcaatctctcttcgttttcttcattgacggcgagatcggtgatgaataacgcgtcctgtctgttgctctccttcgctttttctaaaaagtactgcacctgtgcgtttaagccgttgacagagttataccggacctctacgtcttttccgaacgctaattttgctacgattccacaccctactccgtccaagtcgttatgtgaatataaatgatacataatgtaggcccctttttatgataaactgacaattgccgctagaggtgcggcagcctttatttactattctaaaaaacaaagcgttttatacaaatgtaattagttgacataatgttgttattgtaaatatataaaggagcgctttttttgcgctcctaagttcttgcttttacaccggataaaccggatgctttcgattggtaaatgtcatttcctttgtcatgtatgccttgagccgtttggccagctcatcacgcagcgaattggctgggataacagcatcaatgatcatttctgaagccagacggtagatattgatgtcctctttgtattcctcccgtttgctgctgataaatgcggctctctcttcttctggcagctcggcgatttttttagcgtagacagcgtttacagctgcctcagggcccatgacggcgatttgggcggttgggagcgctagacagcaatccggttcaaatgccggccctgccattgcatacaaccccgccccgtaagcttttcggacaatgacagagagttttggaacagttgcctctgacatcgcagaaatcattttcgctccgtgtctgataatcccagcctgttctacttttgtgccaatcataaaaccggggatatcggctaagaacagcaatgggatatgaaaagcgtcacataaggtaataaacttagccgctttgtctgctgaatcgtggaataagacgcctccttttaccttcggctggtttgcaacaatgccgacaggctgtccgtggattcgtgcgaggcccgtcaataattccggtgcaaataaggctttgatctcaaaaaatgagtcttcatctatgacccgctcaatcagctcatgcatatcaaaaggtgcgttttgattttgcggaatgacgtcggcaagcggagttttgaagtgttttggcgggcgtttctcatgaatgggcgctttttcttgaaaatttgccggaaagtaagacaaataagcccgcgccagctgtatggcttcttcttcagtttctgcaagaatatctccgcagccggagattgagcaatgcatacgggcgccacccatttcttcaagagacactttttctccaataaccatttccgccatccttggcgagcctaaatacatggaggcgttaccgtctaccataacgacgatatcacagaaggccggaatataagcgccacctgccgcagatggtccgaaaagcagacagatttgcggaatgcgtcccgataatttgacttgattgtaaaaaattcttcctgcaccgcgtctccctggaaagacattgatttggtcggtaattcgggcgcctgccgaatcgactaaataaatgagcggacagtttaatttttcggcggtttcttgaattctgatgattttttcaactgtttttgctccccatgaccccgctttcactgttgaatcattcgccatgacgcaaacggtttggccgccgattttgccgatagcggttacaactccgtcagcgggaagcccgtctgacatacattccgcaaaaaaagcgtcttctagctcaatgtcatcgtcaaagagaagggaaagccgctctctgacaaagagcttgcctttttcccgattgctttgatgatacttttccgctccgccttttcgaatccgttcagcccgttctgttcgttccttttcataatccatgagcattgcctcccttttatattcccttgtatacggcccgtcttttttcttgaaaggcctgaagcccttctctcctgtcttttgtcgggatggtttgttcatacgctttttgttcaatcgcaaggcctgtagcgagatctgtctccaatcctctattgattgcaaatttagcctgacggacagcgatcggcccgttggcagaaatggctgcggccagttcctctgcttttggcataaggtcacaaggagcggtgacatgctctacaaggccgatttcttttgcttcgtgtgcggtcacgcgtctgcctgtataaatgaattcttttgcttttcctctgccaatcagccggggcagcctttgggtccctccagcgcccgggataatagctaaccctgtttccggaagtcccagcacagctgattcagttgcgattcgaaggtcgcatgccaatgccaattctagtccgccgcctaatgcgcttccatttatcgcagctatgaccggctgaggcaaggcatcaagtaaagccgccgttctttgaatgagagatacactttccagaacctgatcttctttcagttttatccgttcctttaggtctgcccctgcacaaaacgctttttcaccggtgcctgtgaggatgacgcaacggatgtttgagttaaattcaatttcctggataatcatttgcaggtttctaagcatttccgctgaaagagcatttgctgcctgaggcctgtttaaggtgatcaacgcaatatgttcatttttaacagtgaaaagaatagattctcccattgtatgtgccctctcttttatcaagatgatttaaatgcttgtaaatttcggcttggcagcggtttgcccattttttcttcaatccatttggccgcagatagcagtttttctagctttacatttgttttgatatccatctgttcaagcatgtacacgatatcctcagttgcggcgtttcctgatgaacctggcgcatatgggcatcccccaagcccgcctgccgagccgtcgaacaccgtgatgcccatttggagtgctgtgaccatgttggccagagcggttcctctcgtatcatgaaaatgcagggcaatttgattagccgggaatcgtgccaaaagagcttcaagtacagtttccacttgggcgggattagccgctccaatcgtatctccaagcgacagttcagaaatcccaaattcaaatagagcttctgaaaggcgaatgacttgttcaatggggacatctttttcgtacggacagccgaaaacagtcgagaggtaggctcttgttgtgaggtttgctttttgtgcgtcgttgtttacttgtttgagtatatgaagggattcagaagtggatttattgatgttttttctgttgtgcgtctcgctggcggacataaaaacgcaagcctcgttaatgcctccttcaagtgcattctccagtcctctttgattcgggacaagtgccgcgtacgttaccccttttaaacggtcgatgccttttgctacatcgatagcatctcgaagcgccggaatccatttcgggtgaacgaaggatgtgatttcaatatacgaaagccctgtccgggaaagctggttgatccaggttattttatcctctgttgcgatccatacgggctcgttttgtaagccgtcacgcgggccgacttctttgattgtcacttttttaggatatgacatggtcttcctccaaattattgagtggaattgctcagttcgagcagtacgtctccttcatttacaaagtctccttcattttttttgacttcttttacgattccgcttctatctgcaacgatcgggatttccattttcatcgattccaaaatggctacctcctggcccttttcgatttggtcgccggctttgacgtggactttccacaggtttcctgccatttgtatgctaaccgtcatgacaactgcctcctttataggtgttgtttcaaaaagtcagtcgtgacatccccttctttaaatgcctttgttgccgcagcctgtatgagaagcggaagatttgttttgattccctctacacgatagtcgcgaagcgatgtctctagtttttcaattgcttctgttctggtttggcctttgacaatcatcttagcgatcatcgggtcataaaaaggggtaacggtgctgtcttttgctaccgcacattcgtgtctgactcctttttggtcaggaagtgaaaacgcagtgatcgtacctggtgacgggaagaaggtcttgggatcttccgcgtatattcgaacctctatcgcatgcccgttccgttggatgtctttttgggagaatgtgagtgtatggcccgcagcaatccgcagctgctgctcaactaagtccaggcctgttatttcttcagtcacggggtgttcaacttgcagtctcgtattcatttcgaggaaataaaaattttgcttctggtcaactatgaattcgatggtgcctgcgttcgtatagccgattgcctttgctgcttttaccgctgtttgcccaatcttcattcttagttcatcgtctacaaatggagacggtgcttcttcaatgactttttggtggcgcctctgaacagagcaatcacgttcaaacagatgtactgtatggccgtgttgatcagccaaaagctgaacctcgatgtgacgcgcatgttcaataactttttctatatacatcgacccgtcaccgaaaaaatctgctgcgcgctttttgtttccctcgtacgctttttttaatgcttcttcattttcaacacgctgcattccgatgccccctccgcccgctgaagctttcagcatgacaggatagccgatttgacatgcggtgcggcaggctgcctctatatctccgagggattcagaaacgcccggtaccacagggacacctgcagcctccattgcttttcgcgcttcaattttgctgcccatctttgcgatgatatcaggggaaggtccgataaacacgatgttttcttgcttgcagcgttcagcgaaccgactgttttctgataacaatccatatcccgggtggatcgcgtcggcatttgcttttttcgccgtctttatgattctctctatatttaaataactttcactgactctcgattctccgatcaaataagcctctgtagcggcttttgtatggagcgcgtccttgtcggcttctgaataaaccgcaaccgttttaatgccgagacggctgcatgttcggataattctcattgcaatttctccgcggttggcgatcagtacttttgtaaacatgatttcacctcattgacttgatgataggttgaacatttcaatcgttttttctcgcagtttatatttttgaattttgcctgaggccgtcatcggatagtcatccgtaaaaataacataacgcggaattttgtggcgggcgattttccctttgcaataggctttaagctcatcaggtgaaacgcttttaccgtctttcagtttaatccaggctgcagcttcctccccaaatttggcgtcaggcacaccaacgacctgtacatctaaaacagcgggatgccggtataaaaattcttcaatttcccgcggataaatgttctcgccgcctctgatgagcatatcttttaatcttccggtgatgcggcagtacccgtcttcatccatgacagcaagatctccggtaaacagccatccgtcatgattgattgcttttctggtcgcttctttgtctttataatagcctttcatgacgtgatagccgcgggtgcacagttctccctgcacgcctctttgaacttcttgacatgtcccgggttctacaattttcacctcagtatgtggcagggcgcgtccggttgtttcgactcttcttatgaaggaatcgtttgctctcgtttgtgtaatgactggcgaggcttcggtttgtccataggcgatcgtaatgtctttcatgcccatcctttcaatcacagctttcatcacttcacttggacagggagagccggccatgattcctgttcggagcgtcgatagatcatatgcatcaaaatccggatgatgcagctcggcgataaacatggtaggcacaccatggagcgctgtgcatttctctttttctaccgttttaaggacggtaacgggatcaaattcttgcacgggtatcatggctgccccgacggatacacatgccaaaaccccaaggacgcatccaaagcagtgaaaaaacggaacagggatgcacatgcggtcttgagaggttaaagccatacattcagcgatattggcagcgttattgatgacattgaaatgggtcagcatcacgccttttggaaaccctgtcgttcctgatgtgtattgcatattaatcacattgtctttatccaggctgttcattctctcttcaagctcagcatctgtcactgttttcgccaatatctctgtatcgtcccaatgatacatgccaggcaaccgtttattgccaatatagagcagcgtttttaaaaagggatagcgttcagatttcagttggccgggctttgcttcttgcagttctggaattaaactgttcacgatgtctggataagaagtgcccctgtatgaatccatgataataagcgcggcggcatccgattgctttaacaagtagtccagttcgtgtgcttgataattggtattgacggttacgagcacggctccgatcttcgcagttgcgaactggacggcaagccattcagggatattagaagtccatatggcgacgtggtctccttttccaatccccatccgcataaggcctttagcggtttgacggcacagactgtcaaattgagcgtacgtataacggatatttcggtctggatacacaacagcgtctcgatcgggatacgcatcagctgtttgttccagcagcctgccgattgtggaatggatgagttcagccattcattgttcctcctttcttaatgatgggaaagcgtttacatttttattttaaaagctgtctggcgatcacgagacgctgaatttcagatgtgccttcaccgatttccattaattttgcgtcccgcagcatccgttccaccccatactctttcatatagcctgaacctccatggatttgaatggcttgattgcaagctcttgtcgccatttcagatgcgaatagcttggcgtacgccgcttctttggtgaacgggcggttatggtctttcagccaggcggcttttaacaccatttgccttgccagatcaatttccatcgccatgtcagcaagcttaaattgaatcgcttgaaaggaagaaatcggctgtccaaactgctttcgttctttcgcatatgccaatgatgcgtcaagggccgcttgggcaatgccgactgcaagagcagcgatggagattcgccctccgtccagcgtatatagaaactgtttaaacccttttgttggatcgccaagtaagttggccgcaggcactcttacatcttcaagcaatatttccgctgtattcgaaccgcgaacgcccattttatcgtacgggctcgtaatcgtaagtcctggtgtatcagttggcacgattaatgcggagatgatgttttttccgtctttgtttttgcctgttacggcggttacaataactgtgcgtgcgtagcttgcattagtgatccagcacttttcgccgttgattacatactcgtcaccatttgaaatcgcttttgtttgagtgcctcctgcatctgagccggcatttggctccgtcaggccgaatgatccgagtgctgtgcctgaagccagcggcgtcaaatgcgtctgtttttgctcttctgttccgaagtagtaaagagggcttgcgcctagcgagaccgctgcagcatagcttaatccagtactgccgcaggctttgccgacttcttcaaccgctaaggcatatgaaatcgtatcaccgccagatccgccgtattcttctggaaatggaatacccatcagaccgagttcacccattttttcaaatgtttgtatcgggaactcgcctgtttgatctacatgttcagcgtgaggagcaatttcttttttcgcaaaatcttttaccatttcacgcaccatttgttgttcttttgtcagctcaaaattcacatcgtttcctccttcacatctttgtaacatcctattaggcgagttctataatcattccctgacaagaaaagtctgaaaattaaaactgaatcattttttatgtgataatttcagcggaatgagcaaatacatgcagtaggtgcataccatcatatcgcaaacgcaataacttggccctttgataaagccgggaagatgagggagattccaaagggaaatcgtatcaatcaataaaccgaccgctgatccccatatacctagcttgatcaccgcgaactgtgattgatcgagtttttgatagagaaagaacacaaggcataaaacaagagcggtgcccgcttccaagagaagaaagttcgtcaaaaaggcttcttcagccggatcagtcaacacagcatcttcgaacagcacaaaaaataatgtggcaactaaccagactagaaatgaaaacgtaaaacacgtcctgtacgtgtttctcttcgattttatttagtactaatttctcagattccaataatggaaaatgtccaaacaccgcctccaatatttatgtgaatctcacctttgtttttttaaaaaatacagcgatttaccatcgtttcctgtctccaaaatcactaaaaaagacgacttagaaagccgtccttctcatttcttattttgttgttcgtttggaagccttgctttcgttatgaagccggtctgctgaagtgacataatacgtatatttcttgttaggatctgccgtgttatctaagaaggtttgctgctcatgtgtttttctttgcgttgccagcaatgttctctgctttttcccttcggctctgtatatcgcataataggctgtttctttcgtttttagatttgatgggtgatctttaatctgcagaagattgccgtttttgtcttcggtgactttcgtaagcttcggtttttttggggcggtattgtcaagccaaggcatttgcggaaccagtgccggcttgctgtaaagatcagtgctgagcctttctttgatgccaagcggatttttgttgaggtccttgaggctgaaatgcatgcttcctttcaccagttcaagctggcggttcaaagtgatttgccgcacatattcctcagggtcggaccaaggcggatcaaaattgttattgattttatatgctgcctggccaatatataagtgaacaggcctatttttgacttcattgctccaccaatcagccagcacgtcgtacgccgctgcgttaaagccgatactccaataaatttgcggagcaatataatcgatgtcgccttcttggatccaacgccttgtgtctgcatatagatcgtcataatttctgacgcctgcttttgtattcgatccggtcgggtcatctgctgcgtttctccatactccaaagggactgatgccgaatttgacatacggttttgcagctttaattgtttggttgatttgtttgacaagctggttcacattgtcccgccgccagtcatcgatattagaaaaagcgtcttttccgtattgttcgtactgtgcttgatcaggaaattcctgtcccgctattttataagggtaaaaataatcatccatatgaacagcatcgatatcataatgttttacgacttcttcaatgcctttgacgataaaatctctcgcttctggaatgcctggatgataatacagctggtttccgtaggcggcaacccaatctggatgttttcttgccgggtgactctcagacaatttattaagatctgtatgattcattgtaatacggtaagggttaaaccacgcgtgaaattccaaatttcgtttatgggtttcttcaatcataaatgcaagaggatcatagcccgggtccttcccttggacaccggttaagtattccgaccaaggcccgtaagctgacggataaaaggcatcagccgtcggtttaatctgaacaataacggcattcattcccattttttgcacatcgtccagcagtttgatatactcctgtttttgctctttcacagataacccttttttggacggccaatcaatatttaatacggaagcaatccatacggctctcagctccctgtcagactgcgcattggccataaacggaacggaaatgacaaacgttccgatgatcaagctgacaaggaaacggacaatcgacttttggcaaaccttcattctgtttcttctcccccattacatcactttcactattcgctattacggtattcccgggctataaaagggtgattaacagaatgtctatctcactaaataaacgaaaaaagtcctaaagcatgttgtgggccgcttttaggactttttatcattcatcatggtttgcaaactttttaacacgtcaataagttttacgccgacaccgacagccgtttcaaggatcgcttgtgctccggcaatggctaaaataaagatcagcggtattgcaatacgaggcaaaaaaagatagccaagtccgatcaagatggcacaccaaacaccggcacaccagtagcaattgagcatgtatccaaagttagaagccggcacgcttttttcatctacatgcccgttttgatcaacaatccttttctttttcataaaaggttttcggataaattctgtgattttgtcgaatacaatcaaatgtgtcagcctgtaactggctagaatcagcatgataaacgtaagaaaagatagatgatccatgacaagcctccaagaaaaaggatgatgttatcattccctagtgtcatcgatccattctttgatacaaaaagaagcagacagagaatgcctctgtccgcgaatctgttctattgtttgtgcgggattgctttatttgaagtgatcttttctaaaatgtcaaggatgatgtcagcattcttttcagcatatgttccttccagcatgtctttatgagcgccaaaacccgtgtactcgctgtagtttccacaggcgccttcccatttcgttaagcctgtattctcgctggtttcgatttgaattccagcttcgatgaaatgaatgcttgctttgatgtgcccttcattcagcaattgtgcccaatattcttgatagtttctttttttcttcatcaccttttctctgactgcttcaggcagatatgctgcagattcgtcattcccggtatcaataggcaaaggctgttcttttagataagcgtccacgataatgaagtcgctgacttctaatcctttgcgctccatagcctgtgccacttcaaaagccaggtttccgcctgcagagtagcctaataaaacgtatgggccctcaggctgtatgtccgtcatgcaattaacatattgttcaatgcgggtgtcttgttcaataaagtgaaacccgtatacggctgccttctcattcagtaataaagcaaggtctttaaaataaatgccaaatcccgatatcggcgggaagcagaaaagattttgcgcgccgtgctggttcagtttgatcacatgctgttcatctgccgctgtcagctgtttagaataaagtttttcggcaagctgagcgattgtcggatgttcgaacaagaaatcaatcggtatgtcaatgttctgctgatgttttagtgtatgtatgacttgcagtgcttttagtgaatgtccgccaatagcaaagaagtcatcatcaatactgattgtgttaacaccgaggacttgcttccaaatgttcgccaattcttcttcaaccaagtttcttggcaatatgatgttctgtcgtttggcaggcttattttctggaataggcagcgcgctgcggtctatttttccgtttccggtaagcggcatccgctccacacgcacccagtgctgcgggatcatatagtctggaagcacacgcgccaaatcggcgcgaaaatccgtatctgtttttttatgatcaccgacgtaatgagtgtacagctgcgcctctccatctttttctctcattgtcactgctgcttcttgaacgccttccatttctaacaggcgcgcttctatttcggcgggctcaattcgttttccgcgaattttcatctgcctgtcaattctgctgatgtattctaagtttccatcaggcagccagcgtgccaaatcaccggtacggtaaattctttctccaggcaagaaaggatgaggagaaaaaacagtatttgtcaggtcatctctgttcaaatagcctttagcgaccccatcaccgccaacacaaagctcgccgggaacgcctattggcaaaagacgtccttttgtatctaagatgtaagcggtgctattgctgattggttttccaatcggaatcggccccgcatagtctctctttatttcaaaaaaggttgaaaaagtcgtgttttccgtaggcccgtaaatattatgaagcgcgagatctgggcaggcgtgcctgacagcattgatcagagcaggcgaaagtgcttctcctccgacatataacgtatggagtccgcgaaacatgtcagctcgtacctgtgccagctgattaaaaagagctgtcgttaaaaatagcactgtgatgtcattttcaaacaaatacgctccaaaccgatcaggtgtcagcattgtcgatttatcaatgatatgaaggcttgcgccatgtaaaagtgacccgaacatttcaaaggtgacggcgtcaaagctgatagatccagtcagaataaaccggtcatcaccggacgcagacgtgtaattgctgtttctgacaagggacacgacattgcgattcgtgatcatgacccctttcggccggcctgttgatcctgaggtatacatgatatatgcaagatcgtctggactggagatggtgttgataggaaaatggttctctcccatcaatgcctgcgcatctgcaatcatacatgttcctgagaacgcagcattttgctccagccccttttgaacaatcagcatttttgcttgcgtttcctcaagcataaagctgactcgttcaggcggaagctcctcatcaagcgggaggtatgctccccctgcttttaatacggcaagcacactgatcatgaattcgggagaatgtgcagtcaatattccggctgtctcgtttttccgaaatcccttttgaattaactctctggcgagcgcattagagcgtttatcaagctctttatatgaaatagacatattgccatacacaagtgcggtatggtctggcgtcttttctgcttgttcgcgaaataaatcgataattgtatgattctttggatactccgtttttgtattgttgaactgtgtgacaatctgctctttttctgttgcatcaagaaaagaaaaatcagcaattggcatatgagggtgctgtgccgctgtgctaagcgcttgcgtaaattgcctcttgatacagctgatccaggcagcatcgtaaacgaatgcattatagctgaacttgacgacaagctcttcgccgggagcaacgacaagattaaagttatatcctgattgctcggatacttgaacttgatcgatttgcagcggtgaatcggtttgatcagcggaatcggcgattttctgctgtaacggatagttttcaaagacgataatgtgatcaatcagttcctgttttaatgcggtgtttgcctgaatatcaaataaaggctggcaggtaaacggctcagcttccagcatttctttctggcatcgtatgagcagttcttgaaacgtttcgtcttgatgtgttttaattcgaatcggtatggtattgataaacaaccctatcatttgctccacgcctgggatttctgacggtcttcctgatacaactgcgccaaacacaacgtcgtctgtgcggttatattgctgcagcatcacaccccagaccgcctgaattagggtagcgagcgtgacgccgtgttgtttggcagtctctttcagcttgtctgtcagtggtttatttaatgaaaatatcaaatcttcacggtgataaccttcttttgtttctttatcagacacacgaggcagaggtgatggagtgctgtagttttttaaataggtatcccagtaggctgctgctttttctttgtctcggtttgtcagccaggaaatataggtgctgtacggacggacagggtctaatgaaagcggccttcctgcatgaatcgattgataaatttgcataaattcctgcataacaatacctaggcaccatccgtccattaaaatatgatggtgactccagatacagacatgttcatctttagctgttttgaatagagaaatccgcatcagcatgtctttttgcagatcaaagcctttttgcttgtccttctctttaaagcgttcaatatactcattctgatcgtttgttggcagatgggaaatgtcttcgctgtacaaatggaattcacgttctgtcatcacgacttgccgaggtcccgacaaatgcgggacgtgcggcaaaaacacggttctgaaaatatcatggcggtcgataatggcttgaatgctgcgctgaaaccattcatagctgaggcttcctttaatggtgaagagcgactgctcaacgtatgccccctcctctttacggaggaaggaatgaaacagcattccctcctgcatatgactcagaggataaatgttcttgatttttttgatgttatccatagtgtctgcacctttcttcacggtttcattagtgaaaactgagcatatcagcaatctcttgcagggcgtcctcggttagttcttgatcatcataatcgctgatcgtcttttctgtttctcttttgttctggcagtgttcgatcagctgtaataaaaattgacggcatgtttcgctaagctgttcgatggttttgcgctgaaagcgggcattgtcataagtcatattgacagtcaattttccttctgcagcgattgcgctgatatccagcgactgttcacggttccatgttgtgctgatatcacctccggcaccaagcggagagaatgagaaggcgtcctcctcaggtacttcagctgagcggccgctttcaaattgaccaagataattaaagctgatttctggtgcacctgtgaaattgatgtcttttttgccaggcggcgtcaaatatttgatgacaccgtagccgaatcctttgtcaggtacacgtctcagtgtatcttttgttgtttttagcacatgaaccatgtattcttccgaatctggcaagtctgcgttcaatttaaccaataacggataaatggcggtaaaccatccaaccgtccggctcacatctattccttctaatacatcctctcgcccgtggccctctaatgatagtttgaaggcggattgattggtccaatggcgcagcgcaagaatgacagaagcgagcagcatgtcctgcgtatcagtgttatatgcgctgttggcgtcttttaagagtgctgctgtctctttctcgtttaaggtaaatgaaatcgtggaccgttgtccctcgtgtgctctagttccatcgatttgatcaaaaggcaatgcctctgtttgatactcttcggcttcgcgccaatacttgagctgtttcattagctgctggctttcagcgtagtcagagagctttttcgcatacgctttaaacgagcttgttttaggcggcagtttgatatcctccccgcctgcagcttggcgataccctaaagccaaatcttcaagcagaacccgccatgaaatgccgtcaacgacgaggtgatgagcagataaaaataagaaatcaccgtcaattgtgtggaaaagaccggcttgcagcagcggaccattcttcaaatccattttctgctgaatatcaagtacatgacgtttgataataggctcatacgctctatttccatcagtgccgtccggagctgataaatcaatcatctgaaggccgtacaacgcgtcgtccgaatgactgagaggccgattatattgatcccactttccttgttcattctgtgtaaacaccattcgcagcgcatcatgatgacacgttattgcttttaacgttttgcgcagtgcgtcttcttgtacagaggtgcttcgatgcagcattacggactgattaaaatggtgtttttcttttatatcttgagaaaggaaccatttttgaacaggcgaccactgtacgtctccctcaaccgcagcttggctggaacttgtatctgaatcacggatataagctgccaattcttgaatggtcggatggctaaacaaatctttcactgccatttgcttgcctatccggtgaagccgcgcagatacctgtaacgctttgatcgaatctccgccaagctcaaagaacgaatcagctgttccgatcttttctgcccccagtacttctttccaaatatctgccagtatttgttccattttgctggctggcgggaggaatggacgttcaccttcgtggttgtatacaggttttggaagtgctccgcgatccagcttgccgtttggtgacaatggaagtgagtccagtttttcaataaacgcagggtgcataaacaccggcagcttgttttgtaattctgagcgtacagcatttgtgctcaactctggttttgccaccacataagcacttaattcggtttgtcctgacgctgtttcatgagcaactactgcggcgtcttttacaccatttatacaccggatgaccgattcaatttctttcgtttctacacggtatcctctgattttgacttgatcatcgattcttccgagatattcgagtgtaccgtcggccatccatctggcggcgtctcctgttcggtacattcgtgtttcgggtttaaatggattctgcgtgaatgctctctctgtcagttctggaagattgacgtaccctcttgcaagccctgttcctgctatacaaagctctcccgcaacaccgattggctgaagctgatgattgctatttaaaatcagcacttgagtcccgtcaatcggctggccgatgcttacgtatgcctgcttttccatatgtctcatgacggtagtcgccacgctgttttctgtcggtccatattcgttggcgagttcggtatgcggacatatagctaagctgcggtcgatcaattcgcggtcagccgcttctcccgccagtgtgacgactctaagcgtctttacatcttccggctgcactacgtccaaaagcgctcgatataaaacaggcacaataatcatatgtgtaatccgctgacgagacagctgatgcttaatggccagaatatccttcgcttcctcttcatgaagcaaaacggcttttgcacctgacaaaagcggtgtaaacatactagttataaagccgtcaaatgagaaagaaaagagctgcagaatggtatctgtctcgttgaatgcataagcgtttcgccgccactgaagagtgttggcaatacctttatgctcgaccattaccccttttggacggcccgtcgttccagaggtataaatgatataagccaaatgatgggcagacgacatttgcggcagcggcgatttgtcgtctgcctctacactttctatcgttaagatctctccttcaaagtcagcaagtactccccgatccgcttcatttattgtcatcagcagtttcgttccgctgtcgctaaggatatagcgtttgcgttctgtcgggtattcaggatcaatgggaacgtaacagccgcctgctttccacacaccaagtatggatgctatcatactgaacgaacgatgcatcatgatgcctactggtgtgtccggcttaacacctaagctgcgcaatgcacgtgcgattccattggaccactcgtccaactcttgatacgtcagtgttttgtctccgctgacaagtgcagaagcttttggtgttcgagcagcttgctgctcaaacaattgactgattgtttgaactccgtattgattcgcttgcccggtgttaaactcattaagcagctggtgccgctcttcttgggtcaggatgtcgatatggttgagtgtcacctccgggtttttgccgatgatgctaaatacatttgttaaatgcgatgcccagcgttcaatggtggttttctcgaacaatgcggttgaatattcaaaaaggaaatgaatgtttccgtcgccctcagatgcctgtagtgtcaaatcgaatttagaaacgagatgagaaacttgtgccggcttcatttgcaaatcatgaagatacaatggctcgtaatcattattttgaacaactaacatcgcatcaaacactggattccggctcatatcccgtgtcaattcaagcttatcgacaagttcttcgaacggataatcctggtgctcaaaggcttccaatgctgtctcacgcacttcctgcaaatactgtgcgaatggcttcccgccctccgggcgtgtccgannnnnnnnnnnnnnnnnnnnnnnnnnnnnnnnnnnnnnnnnnnnnnnnnnnnnnnnnnnnnnnnnnnnnnnnnngacagatgatatcttcctgtccgcttaagcgtgacaagaacgcggtgtaagccgcaagaagcaccatgtacagtgtgcttccgttttctcgtgccagcttgtgaaggcctgatgcaacctcttgttccagcgtaaatgagaccttgtcacccgcgaagcttcgcaccggcgggcggacatgatcagccggaagatccagcacaggcagctcgccctcgagctgcttcagccagtacgcctcctgcgttttgtacacgtctcctgttttgaatccttcttgccatacggcatagtctttatattgaatgcgcagtgccggaagcttccgattattgtacagctcgccgnnnnnnnnnnnnnnnnnnnnnnnnnnnnnnnnnnnnnnnatgatgtgatgcatatcaaccagcaacaggtgccgctcatctgacccctttacgatttgggcacggaacagcggcgcttggctgagatcaaacggtttgataaatgagactgcggcctcctgttcggttcgtgcgccgagaactgtagtctgtaatgtaaacggcacctcgtcatggatgcgctgcaccggatcgccgctttcgtcctgttcgaaggaggtccgaagcgactcgtggcgcttgatcagctctttgaaagccctgtccatcctttcagggttgagctttccttcgagctctaacacagccggcatattgtagcctgtccctccgtcctccagctgctgaaggacataaatccgcttttgggcagaggaaaccggataggtttcctgtttttcagcgggcttaatcgcttcatatggactgtccgttccttcacggataacggtagccagcccttctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaggtcttcgcatctgccgctccgccaggagctggcagggcttttcggtcgagctttccgcttggcgtaaccggccactgttccatctctatcatataggctgggaccatgtagcctggcaacagtctctcaagctgtgcccgcacttcgtttctttcgagcccttctatataagcgcataattccggctccccgctgtctgtacgtacggtaacggccgcctcccttacactttctatacttcttagtgccgcttcaatttctcccggctcaatccggtagccgcggatttttacctgatcatccgtgcgcccgaggaattcaacattcccgtcagggagccagcgcgccacatccccggttttgtacatgcgttcacccgggtaaaacgggtccttaagaaaacgctcctccgttaatgccggccgattcaaataacctctggcaacacccgctccggcaatgtacagttcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcccgccctccgggcgtgtccgaagcgccagcgtgttcacaaacatgccgagtatcggctcaagatccttgtgcggccggccggcaattggcgagccgacgatgatatcttcctgtccgcttaagcgtgacaagaacgcggtgtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaagcttcgcaccggcgggcggacatgatcagccggaagatccagcacaggcagctcgccctcgagctgcttcagccagtacgcctcctgcgttttgtacacgtctcctgttttgaatccttcttgccatacggcatagtctttatattgaatgcgcagtgccggaagcttccgattattgtacagctcgccgaattcccgaatcagaatgttgacggaaacaccgtctgaaatgatgtgatgcatatcaaccagcaacaggtgccgctcatctgacccctttacgatttgggcacggaacagcggcgcttggctgagatcaaacggtttgataaatgagactgcggcctcctgttcggttcgtgcgccgagaactgtagtctgtaatgtaaacggcacctcgtcatggatgcgctgcaccgggtcgccgctgtcgtcctgttcgaaggaggtccgaagcgactcgtggcgcttgatcagctctttgaaagccctgtccatcctttcagggttgagctttccttcgagctctaacacagccggcatattgtagcctgtccctccgtcctccagctgctgaaggacataaatccgcttttgggcagaggaaaccggataggtttcctgtttttcagcgggcttaatcgcttcatatggactgtccgttccttcacggataacggtagccagcccttctaccnnnggatgggcaaacacatcttttagcggcacctgtacatcgaattctttggcgatccgtgagacaagcgccgttgcttttaaggaatgtcccccgcggtcaaaaaagttgtcgtgaatcccgacagggccatttttcagcacgtcctcccatagctgagaaagtttcatctcagtcacgtttcccggcgccgtgtaggtcttcgcatctgccgctccgccaggagctggcagggcttttcggtcgagctttccgnnnnnnnnnnnnnnnnnnnnnnnnnnnnctatcatataggctgggaccatgtagcctggcaacagtctctcaagctgtgcccgcacttcgtttctttcgagcccttctatataagcgcataattccggctccccgctgtctgtacgtacggtaacggccgcctcccttacactttctatacttcttagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccagcgcgccacatccccggttttgtacatgcgttcacccgggtaaaacgggtccttaagaaaacgctcctccgttaatgccggccgattcaaataacctctggcaacacccgctccggcaatgtacagttcgccggcgacaccagaaggctgtacggctaaatgcggatctaaaacatacaaacgcgcaccgggtacgggcttcccgatcggaatccgcaaacggtccctgtccctttctggatccaacacgtaaaatgccgcgtctacagtggcttctgtcggcccgtaaccatggattaatgatacttgcggcaagatagaagcaaaacgggctgccgtacgcggcgcaagcggttcacctccggcgaatacacgctttaggtttgtcccgtcaccgagcgctaacatttccgcttgatccagaaagctgttcagcatagccggaataaaatgagccgttgtaatacgttcctgatgaatggcttgtacaatcaatccggggtctttttcccagccgggcggaagcagatacgccgaagcaccggaaagagcccaccaaaacagctgccacacagacgcatcaaaggaaaaagaggttttcaccatgacaatgtcatcttccaaaagcggaaactggtgctgcatgccggtcagaaaggaaacagcctgacggtgctcaacggccactcctttcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagagatgtcatgtccacttcaagcatttcgccagaaaagtttggtgcggagcatcccggctgtgtcagcaagagcgatgccccgctgtctttcagcatgtagctcagccgctcctttggatacgcaggatcaagcggcaaatacgcccctccggccttcaagacagcaaggacagcgatcagcatgtcaggtgagcgttcagacaggattccgacgatactttcgtttgtgacaccgcgtgccgcaaggtgcgcagccagccggctggcgtacatatcaagctcagcgtatgtcagcgaaccgcctgaaaagcgaacggccagccgctccggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttgaacaactaacatcgcatcaaacactggattccggctcatatcccgtgtcaattcaagcttatcgacaagttcttcgaacggataatcctggtgctcaaaggcttccaatgctgtctcacgcacttcctgcaaatactgtgcgaatggcttcccgccctccgggcgtgtccgaagcgccagcgtgttcacaaacatgccgagtatcggctcaagatccttgtgcggccggccggcaattggcgagccgacgatgatatcttcctgtccgcttaagcgtgacaagaacgcggtgtaagccgcaagaagcaccatgtacagtgtgcttccgttttctcgtgccagcttgtgaaggcctgatgcaacctcttgttccagcgtaaatgagaccttgtcacccgcgaagcttcgcaccggcgggcggacatgatcagccggaagatccagcacaggcagctcgccctcgagctgcttcagccagtacgcctcctgcgttttgtacacgtctcctgttttgaatccttcttgccatacggcatagtctttatattgaatgcgcagtgccggaagcttccgattattgtacagctcgccgaattcccgaatcagaatgttgacggaaacaccgtctgaaatgatgtgatgcatatcaaccagcaacaggtgccgctcatctgacccctttacgatttgggcacggaacagcggcgcttggctgagatcaaacggtttgataaatgagactgcggcctcctgttcggttcgtgcgccgagaactgtagtctgtaatgtaaacggcacctcgtcatggatgcgctgcaccggatcgccgctttcgtcctgttcgaaggaggtccgaagcgactcgtggcgcttgatcagctctttgaaagccctgtccatcctttcagggttgagctttccttcgagctctaacacagccggcatattgtagcctgtccctccgtcctccagctgctgaaggacataaatccgcttttgggcagaggaaaccggataggtttcctgtttttcagcgggcttaatcgcttcatatggactgtccgttccttcacggataacggtagccagcccttctactgtcggatgggcaaacacatcttttagcggcacctgtacatcgaattctttggcgatccgtgagacaagcgccgttgcttttaaggaatgtcccccgcggtcaaaaaagttgtcgtgaatcccgacagggccatttttcagcacgtcctcccatagctgagaaagtttcatctcagtcacgtttcccggcgccgtgtaggtcttcgcatctgccgctccgccaggagctggcagggcttttcggtcgagctttccgcttggcgtaaccggccactgttccatctctatcatataggctgggaccatgtagcctggcaacagtctctcaagctgtgcccgcacttcgtttctttcgagcccttctatataagcgcataattccggctccccgctgtctgtacgtacggtaacggccgcctcccttacactttctatacttcttagtgccgcttcaatttctcccggctcaatccggtagccgcggatttttacctgatcatccgtgcgcccgaggaattcaacattcccgtcagggagccagcgcgccacatccccggttttgtacatgcgttcacccgggtaaaacgggtccttaagaaaacgctcctccgttaatgccggccgattcaaataacctctggcaacacccgctccggcaatgtacagttcgccggcgacaccagaaggctgtacggctaaatgcggatctaaaacatacaaacgcgcaccgggtacgggcttcccgatcggaatccgcaaacggtccctgtccctttctggatccaacacgtaaaatgccgcgtctaccgttgcttctgtcggcccgtaaccatggattaatgatacttgcggcaagatagaagcaaaacgggctgccgtacgcggcgcaagcggttcacctccggcgaatacacgctttaggtttgtcccgtcaccgagcgctaacatttccgcttgatccagaaagctgttcagcatagccggaataaaatgagccgttgtaatacgttcctgatgaatggcttgtacaatcaatccggggtcttnnnnnnnnnnnnnnnnnnnnnnnnnnnnnnnnncaccggaaagagcccaccaaaacagctgccacacagacgcatcaaaggaaaaagaggttttcaccatgacaatgtcatcttccaaaagcggaaactggtgctgcatgccggtcagaaaggaaacagcctgacggtgctcaacggccactcctttcggctgcccggtagagcccgatgtatagatgacataggcgagtgaaccgccgtcagctggagtaaactcatggttttctgctttttcgctcgcaagagatgtcatgtccacttcaagcatttcgccagaaaagtttggtgcggagcatcccggctgtgtcagcaagagcgatgccccgctgtctttcagcatgtagctcagccgctcctttggatacgcaggatcaagcggcaaatacgcccngccggccttcaagacagcaaggacagcgatcagcatgtcaggtgagcgttcagacaggattccgacgatactttcgtttgtgacaccgcgtgccgcaaggtgcgcagccagccggctggcgtacatatcaagctcagcgtatgtcagcgaaccgcctgaaaagcgaacggccagccgctccggtgtgaaagctgcctgtcgctcaaacagcccatgcagggtgaaagctttaggcgaaacagcttccgtcttgttaaactcatacaacaatttttgcttttctcttgtattcgtcatatctaattctcttataaagctgtgcggatgtttaagggcgttttccagtatggtaagcagatgagattgtattcgtttaatatcctcaagagaaaacaaggtattttgatagtcgaaatttaattgaatggttccattgtctatccgttcttgtatttgaactgaaagctcgttcgcggtgtatccgctgaaataaagcgctgtttcatagtcaaaatcatctgcattgtgccactgaagtggctgatactgcatagatataccgataaggttgtgtaaatccttctgttcatttcttaattcatttacaagcaaattataaggaaaccgttgatgacgcataacagaaagctgttccctgcctattgtgcggacaaaggaaagaaaatctgtgtcaggatcaaccgttattctgattggaagagaactaacgaacatgccgagcatttctttttcagcctttgaccctctgttgccatagtaggtgccaatggcaagatcttttttagaagtgattcggctgatgcatatgtaaaatgaagccataaataaggaaatgatattgatcttgtgtgcttcgcaaaagattcgaatcgtttgctctagatcaggtgaaagaatgatggtgtctctggatgcagatgtgctctgtttttgtaaggacgtctggtcggctaacgagtggtattccaacgggtgctcaaaggtttgcgtccaaaataaacggtcctttgcaaaccgcggagattgtagatattgactctctttttcgatgtagctcaagtaagaaggttccggctgatcaggtaaaggatctttctttttcattttttgataaagatctataatttgatttcccatcacatttaaagagattccatccattatgatatgatggaatttcgcaaatagccaaacttcatgagagtcaattctaaggaggtaaaattgataaagaggcgagttgaacagtttaaatggaatgctcgcttgatcctgaatccattgctctatttctatcatttcaacatttgaaaaatcaattattctaagtggataatatttatattcagtaaggtgcaatcgcggctcaagctcttctccttctaacagctgaaatctaatggcgtcgttgcgggagatggaatgattcagcgctccctctagagtatcaagctcaatattgcctttgaatttcacacaggctgtgagattgcaaatgctggtatctggctccagcagttcggtaaaccacactctcctttgggcatgggttaaagaataagtatgttcgctcaacggattccctccagttctcataataagaggataagaaaaagtagaaaaaaacagaaaaatgtcaataaaagaaattatatgactatataatccatatatgcactatattaacggatattttttaaagtacaataaaaaacattaaatttttataacatttttttgaatatagtattatttctttatttttcgtttctttttttatcaaatttccggatataaagtgataaaagtattgttttacataaggtcttatacactactttttaatcgaactaattttcttttgtgcatcattcttctaattgttggaaggttcgacaaagcgttattacagacataaaaaaacctgttttctcttggaaaacaggtctgccgctattattgatttgccaaaatgacagcgatttgatcctcaatatcttttccatcctcttcatcaatcaatccatttagaagaatagagaaaacaagtttttttccgctctttgtttctgcgtaccccgatagagagcttaccgtactgagcgatccggtttttgctcttacttttccttgtgcaggagtgtctttcatgcggtttctcagcgttccgcccaccattctgtcaggattgcccgcaacaggtaaagaatttagataagccgagaaccaactctgatcctgaatgtcatataacagctgtgaaagttgatctgaggatacagcatcaatatgtgagattcctgatccgtcccttaagacgagtgatttagaatcaacaccaaattccggaagcgtactgtttaacacttcgagccccttttcccagctcccttctccttttttcactttccccatctcttttacgagcacttcggcatgtccgttattacttaatttcatgaacggcacaaaaagtttcgataaaggcattgagcgatgagagagcagcacatctgaagaactaggtgcttcacccgtcttgatgtcccctttcacagtaataccttgtttttttagtgactgcttaaataaatctaaggcatatccggcaggctcccagacagaaatccattcctttgtcttgtttgcgtcaaccggtacgctcccttcaattgtaatcgtgtttgttccatgctctctttcgattgtgaggtctttctctgaaccggcagcagtcgttttagcatcgttctttatcgttatataatcggttttcggagagacagacacggcaggctcttccccttctttttgatttggggttacctcaacaatcacagtgcctgcatcatagtcttcgtttggagacgctgttagagcggagattggcgcgccataatatgtgtattcatcgctccaaggcatatcaggtgataatcgcatgtcatcatgccacgtatcatcaccgatcagattgcctttaattacttttacgccggaatgtttcaatttctcagccattttgtcaaaatcagatggtaaaagtgtcggatcgcctttccctttcaaataaaggttaccattcagctttttccctttcagtgttccatccgtccggacctcggttgtaaaagaatagttctcgccaaggacagaaagtgccgcggccgctgtcaaaagctttagagaagaggcaggcctcattcgggtgtctcctgaatgttcatatagaacagcacctgtttccgcagagcgaacggtgatgccggccattgcgccttcgagggcaggatgatcagctaaaatcttatcgatctgcccggaaagtgcatcttgtttttcagcggcaagcgcagcctgatgcatataaggcaccgaagcaacaacgaaaagcagtaaaacagcaacataaagctttatgctttttttcattcatttccccgcctctctgcgcttcatcattggctattgatgattcagttcaatggtgatactgcttttagctgtcgtttcttctcccggctccagcacttgtaaaccagtgagtgacgaaggtaaatcaagattcacggcgtttgtcacccatgtgtaaggctcagggcataaatacccttgttttccgtccgcattgtatacaacccaatggttaaaatgttcatctgccttataaataatgctgatatgtgcatgctgatgataaatgactgcctggttttctccgcccctcttctgataggaagataaaaagacatcatccagctgcttgtggcgcaaatccattccttcatgcaaagcttctttattcggtacatccatcagtttcccggtcggcagcaggcgttcatccaactcccattgctgatctgctgtcagggagaataacgagctttctgccggaaacacaaatgtagtatgatacccaattccccaaggaaacgcttcctttcctttgttcatgaccgtcgcatgtttaaatagggtattccccttgatcgtgtatgtcatccgaacgacggcatgatgaggaaattgattctgcacatggggaagctcagaaagatcaatttctgtttcaacaatcactccttcatcagtttgcttcgtggtcacgacattccacttttcatggtaaagaaacccatgaagatggttgtgtttatccttctcgttgatatcaaaatgatacgttctgccccggaaactgaatgtaccgtcacttatgcggttaggcgggaacaggattggaatgccatacaatgttggtgtgtcgtgaaaactttctgctgtttccggttcacgcaaaagctggacatttgttgttttgtccacgagagaaatgacgttgctcccccactcagggacaacaatcatttctagatgttcgttgcccgctttgatggccggcgttcccaaatacgtgattttctcaataaagtttgccatgtttactcaacctctccttgattcattgctagtataagaattcaatgtactgtaccatatttcctccattttatattttcccctatcaaataaaaaaacaccgttcaacttatgaacggtgtgattcggaggctattggatgagacgtgtgatttgtttctttttccagacgaattgataatacccataaatcaacagcaagctgacggcaaacgcagctggataaccaacccagacgccgagtatttcaagctttgtatagtgagaaaggacgaaagcgacaggcacctctactccccagattgcaaaaatactgatgacggtcggccataaaaccgttccgcttgcccgcatcgttgcagaaataatttgggcatttccaaacagcaaatagctccacaatgtaatcatcaaaagacggtgcgcaatgtaaagcgtctcttgctcggttaaaaataacgataaaatctgatgtgaaaaaacatagatcagaatgatcagtacgccgccaatgatataattcagccaaatccccacgcgaatgacctgctttaagcggtcaaactcgttcgctccgatcgattgcgcagcgaaaatagaaaccgcaataccaaggctgacggccggcatctgtacatagctggccacctggttgaccactccgtatgcagctgttgcattagagccgtaatgattgacgaatgaaataaccgctatctctgataatgagacaagaatcatattgatgcttgctgggaccccaagacgcagcaggagaaccagcagttccttatccattgtcaaataacgacgcactgttttatcaaattgcagcgggtgttttcgctttcgtaaatacaccattaacacgagaaaagtcgcaatcgtagaaatgacagttgcatatgccgagccgtatatgcccagtttcggaaaaccaaacatgccaaggattaagacaggcaaaagcgcgatgttgataaccgtgctcacaatcagcgtataaaacggtgtcttggaatctcctgttccgcgcaaaaaggtagtatatgcaaaatataaaaacataaacggcatagcataaaataaaatacgtgcatagttagcgctgacatgaatgacattttcaggcgtacccattaaacgaaggatatccagggtgaaaatactgccgatgacggctaacacaacgcctaataaaaatgtaaacgtgagcgtcgtcccgacaacagcctttagccgttcctcatttttcgctccgtaagcttgtccgatcagaatcgaacttcctgaaccgatcccaatcgtaaatgagattaaaagaaaaaataacgggaaaaaggatgatacagctgccactgcatcaacaccgagccatctgcctacagccatcatcccgactagctggccgactgattgcagcacattgctcagcagaagcggcactaaaaagagtgacatcgaccgccaaactgatggtttgcttttcttttgagttacaagaggttcttgtgatgtttccatattaaaggactcctttatttgaaatcgtttttaaacatgccctcattttttgacaaaaacaggatatgtaacatgttattattcatcactgcacatatgaaacccttcccgattcttctaattttacacatctttttagcttatgaagaataaactagcaagtaatggcgtattttttgtgagtaaaagaataaaaaataatttatgcaaaagtattgtaatctatccgtaattattgtaacatttgtaacataagagaaagagattttgaaggagagagcgataatgaaaaaatgtcttctatttctaacaaccattgcacttattctgtcattaagcacaaatgcatttgcgaaaaatacatcaggcgatttatcacaaaaacaagcattacagttggcattatccgctagagaacatttttggaacaccatgagcggccacaatccaaaggtgaaaaaagcagtttgcccatcaggcacattcgagtatcaaaatcttcaatatgtatacatgtgcagtgatctaggcactaaagcaaaagcggtgaattacttaactcctatttttacaaaaacagcaatcgaaaaaggctttaaagattatcatttcactgtttctaaaggaaaacttgctgttccaatcggtgacggagacaatcttttgaattggaaaaaatcaactgctaaactggtctctaaaaaaggcggcacaatcacatacgaatttaccgtccctacattagacggatccccttctgtaaaacggaaagtgacattcgtgaaagaaaataaaaaatggaaagtcaatcaatttgacgcagttatataagaaaaacgcccggtataagcgggcgttttttatttggtttgcataaagaaagacaacaggcgaaaagtgcctgttgtctttttgtgaatataacgctctaggagagattcgaactcccgacctgcagtttaggaaactgctgcactatccgctgtgctactagagcttttggtatttatatagtagctctgatgatcaatattttcaagcgatttgtattaaagccctccaaaaaccttatatgcggctcttgtcgtatcttcatcaataccgatataccgcattgtaattgatggtgatgaatgattcagtattctctgcagctcggcgatgtctttcgttcgctgataaaaatgatagccaaacgttttccggagtgtatgcgtccctatctcctcaagtccgcacgccgcagcggcctctcttaaaattctgtaggcctgaatgcgggaaatcggcttcctggtccgcactgatttaaaaagatattcgttttccttcatgtctttcgtatactcgtatatttcctgtttcagcgattctaaaataagaatctttcttttctttttcgttttgctttcagtcgcccataaatgatctttattttgaacgtccttcacttgcagcggcagaatatcagaaatgcggagcgcgctgttgatgccgaaaataaacagaaaataatcccgcttgtttttgttaagcaaatactgtttgacttcttggattttctctagactgcgaatcggctgtacaatatgcatcaaaaaactccttaaaaaccgttatgtaacgttttgaggtctatgttactattatagctgaaaaacgttgaatgtcaaagtgcggcggcatttatgtaacataatatacatagtgttacataatcttttaaagtagcttcttcaaacctccaccctataaaataagctttaaagcctcttataaagcttttaacctcttggatacttatccccctactaatcatcaaaaaacctcttaaaacgaaatctgacactcccgattttctggagcttccgcaaaaatatacaaaaaaaagacacaatttcaaattgtgtcctaatcctcatcctttacatcaatatcttccgggatcggttcatttaatatttcctgcaccagtgctttgtaattctccagctgttcgagatgcgttttgaactgttccttataaatcaaaaattgctccccgtcatgaacggctctgattttcccttcgagcaccaagcttttaatataatcctctgaaagatttgtatattctgctgtttcttcaatcgttaaatacatatagcagtcccttcttaatccgtatgctgattctaatatagcacatggctcatatcaatataatcaattttgcacagaaaaacggctttatgtactatataatataccatttgtcacttgtgaaaacgctgtaatttttttacgctaagattgtaacaatacagcttcatataggagggagaacatgaaaagaacgtggaacgtctgtttaacagctctgcttagtgttctgttagtcgctggaagtgtcccttttcacgcggaagctaaaaaaccgcccaaaagctacgatgagtacaaacaagtagatgttggaaaagacggcatggttgcgaccgcacatcctcttgcttctgaaatcggtgctgatgtgctgaaaaaaggaggaaatgctattgacgcagcggttgccattcaatttgcactcaatgtaacagagccgatgatgtcaggtattggcggcggcggttttatgatggtgtatgacggaaaaacgaaggatacaacgataatcgacagccgtgagcgtgctccagcaggcgcaactcctgatatgtttctggacgaaaacggcaaagcaattcctttctctgaacgtgtaacaaaaggtactgccgttggtgttccaggcactctgaaagggctggaagaagccttggataaatggggaacccgttcgttgaagcaattaattaccccttctattaaactcgctgaaaaaggctttccgattgattcggtgttggcagaggccatttctgattatcaggaaaagctttcacggactgccgcaaaagatgtatttttaccaaatggcgaaccgcttaaagaaggagatacccttattcaaaaggatttggctaaaacatttaagcttattcgctccaaaggcactgacgctttttataaaggaaaattcgccaagacgctttctgacactgtccaggatttcggcggatcaatgacagaaaaagatttagaaaattacgacattacaattgatgaaccgatttggggagactatcaaggctatcaaatcgctactactcctcctccaagctccggcggtattttcttattgcaaatgctaaaaatccttgatgattttaacctttcacaatacgatgtccgctcatgggaaaaatatcagctgcttgctgaaacgatgcatttgtcatatgccgaccgtgcgtcttacgcaggtgatcccgaatttgtaaatgttcctctcaaaggcctgcttcaccccgattatatcaaagaacgccagcaattaatcaacctagatcaagtgaataaaaaaccgaaagccggtgacccttggaaataccaagaaggatcagcaaactataaacaagttgaacagccgaaagacaaagtagaaggccaaacaacccactttacagttgctgatcgatggggaaatgttgtttcttacacaacaacaatcgaacagctattcggaacgggtattatggtccctgattacggtgttattttaaacaatgaattaacggattttgatgcgataccaggcggagctaacgaagtacagccaaacaaacggcctttaagcagcatgaccccgacgattttatttaaggatggcaagcctgtcctcacggttggatctcctggcggggccacaattatttcatccgttttgcaaaccattctctaccacattgaatatggtatggaattaaaagcagctgttgaagagccgagaatttacacaaacagcatgagctcttaccgttacgaagacggagttcctaaagatgtcctcagcaagctaaacgggatgggccacaaattcggcacaagtccggtggatatcggaaacgtgcaaagcatatcgatcgaccatgaaaacggcacctttaaaggtgtagctgattcaagcagaaacggagcggcgatcggcattaatttaaaacgtaaataaataaaaaaactgtactcgcttcaaatgagtacagtttttttatacacatctttaaaataaaaactgacaaacgtctttattctgctaatgcacgtctatcttcatcttttcatttcgtttatctcatcaagaaatgtctgaaacgcactcgtaataaaaaagtcttttctgtatataaagacgatctctaagtcttgatatgatggtggcagctgatgaatccatacatttgtacgatgctcggagccgtcaacagcggactttgggagcagcgccgtacccatcccggcggaaacaccttttataatagcctccaatgtgccaaactctatgattttttgattgtgtatgcctgcttcctctagtaatcttttgaccctgtcacgatgagaacagccagccccaaaaaagagcatcggctgctgaagcatgtcttctgccgtcccttctcgtgatgaaatcaaaactaattcatcatgggagacatggagttgtctaactgcagcgtgttcaaccggtccatatacaaaagcgccatcaactttatgatcaagaacctgttgaatcaaatgatgcgtatcagctgtgttcactgataaatccacttcaggaaaacgcctgaggaaggatgctgcatgctcaggcagatgcgttaccgccattgtttccagtgatccgatccgcaaaggcccttttggttgcctgctcattcgggtcgatttttcagcttggtctaacagcgataatacttgatctgcatattgtaaaagattttctcctgcagcagtcagcttcattccccgattcgttcgatgaaaaagcctgatattcaaatcttcctcaaggttatgcactctggctgtcacattcgactgaacataattcagcatttgggctgctttcgttatgcttccttcgcgagcaacagcctgaaaaatctttaaatctccgctttccacgcgctctcacctgcttgctatgatgaaaagtgatattggctatcatatttgttcattttactcgaagaaaaccgctatgtaaaatatgtaaagatatgaaaatacaaataatgaggaggcagacagcatgaaagctgtaattcacaacggaaaagccggtcttctggggttatcagttcaggacgttccatcaacaaagcctggatacggagaggtaaaggttaaattaaaatctgcaggcctgaatcatcgtgacttgtttcttatgaaaaacaaatctgaacaagatcctcacatgatactgggttctgacggcgcgggtatcatcgaagagattggtgaaggcgtgaaaaatgttactgttcagacagaagtagtcattttcccgacattgaactgggatttgacagaaaatgttccacctgtacctgagattctgggaggtccttcggacggaacacttgctgaatatgtgatcattccttcacaaaatgcaatcaaaaaacctgcttatttatcttgggaagaagcgggcgttttacctttatccgctttaactgcatatcgggctctgtttacaaaggggcaattaaaaaaaggcgagcatctattgatacccggcatcggcagcggtgtagcaacctacgctttatttatggctaaggcgattggggcaacagtaagcgtgacctcccgcagtgaggagaaaagaaaaaaggcgctgaaattaggtgctgattacgcatttgacagctacagcaattgggatgagcagttgcagggaaaaaaggcggatgttgttcttgacagcataggacctgccctcttttcggaatacttccgccatgtaaaaccaaatggccgtattgtcagctttggggcaagctcaggggataatctcagttttccggtgcgttctctattctttcctcaggtcaatgttttgggaacctcgatgggaagcggtgaggaatttcaagctatgctcgctttcattgacaaacataagctgcggcctgtaattgaccggatatatcctttaaaaaaagcatgtgaagcatataaaagaatgcaggaaggcagacagtttggaaacatcgggatcgtaatggaataaaaaaagaaaccggctggcagccagaccggtttctcttatatgataatcccctttatttacggaagaactgaactccccatcaaatatcgatccacttcacgcgccacttcacggccttcattaatcgcccatacgattaagctttgccctcttcttgcatcccctgcggcgaatacaccatcgatatttgtttgataatccccatatgctgcactgattttgttatttactgaatcaacaccgaactgtttcaacagcggctgttctgtgccttcaaagccgatagcgataaagacaagctgagcaggccatactttttccgttccaggcagctcgcggaactcgtattttccatgctcatttttcactttttccatttggatggtatgaagctctttcagctttccgtttttatccgcgaccatttttgtcgtttgaatggagtattctctcggatctcttccgaattttgcttctgcttcctcgtatgcatattcaagcgtaaagacgtgtggctgttcaggccacatattgtcattcgtgcgggctggcggaagtttcgggtgtttgccgaattggtgcacgcttttggctttttgacgcagagcggtagccacacagtcagctcctgtatctccgcctccgattacgatgacatctttccctttggcatcaatgaattgcttgtctttaaaattagaatctaaatagctttttgttgcaagtgtgaggtagtccattgcgtaatggactccttttgagtcgcgtccttcaattaagaggtcccgctgtttttgagcgcctgtgcataagatcacagcatcaaattgctcctttagctcatcagctgtaatgtcaacaccgatttctgtgttcgttacaaaatcaattccctcttgcgtcagcaatttaattcggcgttctacaatgcccttctcaagcttcatgtttggaatgccgtatgttaaaaggccgcccgctctgtctgctcgttcaaaaacagtgacggaatgtcccgcttgattcagctggtcagcactcgccagtccggctgggcctgacccgacgatggccacttttttgcctgttcgttttttaggaattctaggttgaatccagccgttctcaaatcctttgtcgataatggttcgctcgatatttttaattgaaacggccgggtctgaaatcgctaaagtgcatgatccttcacaaggagcgggacatacccgccctgtgaattcaggaaagttgtttgttttcaacaggcgttccaatgcttccttccatctgccccggtagacaagatcattccattcaggaattaagttgtaaatcggacagccggatgtaaatccgttaatgtccgcaccgatctggcaaaacggtgtaccgcaatccatgcaccgcgccccctgccgtttcgatgcttcttctgaaaaaggagcagaatattctttccaatcctttaagcgagtgagagggtcccgctccgcaggtttttctcgtttgatctccataaatccagttggtttccccatgttcctctccccttccttactgtactaccgcttgtttttgtcccgatgctgctgtattctgctttggcttcgtgttggcctcaaaagcgaacatgatggcttcttcatctgataaacctgcagctttttgctcttcgatgcttgcgagcatttgtttatagtttttcggaatgactttgacgaattttttcacactgtcttcccattgatcaagcaaatcttctgctttttggctgtttgtatatgcagtatgtctttcaagcattgctttgatttgctggatttctttctcgtcctctaatgattcaaataaaatcatctcaaggttgcatttgcgtttaaacgctttgacatcttcggccagtacataagcgattccgccggacatacctgccgcaaagtttttgcctacatcaccgagaacgacaacgctgccgccagtcatgtattcacagccgtggtcgccaataccttctacaactacgttcacaccgctgtttcgaacggcaaagcgttcaccagcacgtccgttaatatatgcttctccgcttgtcgcaccgtaaaaagccacgttgccgataatgacattgtcatccgaagcagagttgaatccttctggtgacttgacgatgatttttccgccagaaagcccttttccgacgtaatcatttgagtctccgtccaaataaagcgtcatccctttaggaacgaaagctccaaagctttggccggctgatccggtaaagtgcagcttgattgtatcttcaggaagaccttcttctccgtaacgctttgagatttcactgccggttatcgttccggctacacgatttgtattattgatttcaatcgaaatatcagcttcttttccagattcgatggcttcttgtacagccgggagaattgttgtgatatcaagcgattgatcaattttatgattttgcggcgatcggaacgtccgcaccccttcaggctgataaagaagtgtagacaaatcaagctggcttgctttccagtgccccttcgcccgttcacttacatgaagtacatcagtgcggccgatcatttcatcaaatgtcttgaagcctaacgcagccatgtactcacgaacctcttcagcaatgaacagcatatagttcacaatatggtcaggatcccccatgaactttttgcgaagctctgggttttgtgtcgctacaccgacagggcatgtatccaaatggcaggcacgcatcatgacacagccgagtacaactaacggagccgttgcgaaaccaaattcttcggcgccgagcaaggcagccatcacaacgtcgcggcccgtcatgagctttccgtctgtttctaatacaacacggtcacgaagtccgttcagcattagtgtttgatgtgcttctgcaaggccaagctcccacggaagccctgtatgtttaatactggttttcggagaagcgcctgtacctccgtcatagccgctgatcacaatgacatctgcagtcgctttggcaacacctgcagcgattgttcctacacctgcttttgacaccagctttacgctgattcttgcgtcacggttggcatttttcaaatcgtggatcagctgggctaaatcctcaatcgaataaatgtcatggtgtggcggaggtgagattaatccgacacctggcgttgacccgcggacatcggcaacccatggatataccttgttgccaggaagctgcccgccttcacccggcttagcaccttgagccattttaatctgcagctcatcagcattgacgaggtaatggcttttgacaccaaaccgtccggatgcaatttgtttgatcgcacttcttctatcatcgccgttctcatctggaacaaagcgtttgggatcttctccgccttcaccgctgttgctttttcctccaagacggttcattgcgattgctaaagcttcgtgcgcttccttactcaaggacccgaatgacatcgcacccgttttaaaacgtttgacaatcgattcagcggattcaacctcctccaacttcaaaggcttgcggtttccgtcaaatgcgaacaagttccgcaaaaacccgatgcgttcttcatcagccgcttttgtatactgtttaaacagattgtaatcatttctgcggcacgcccattgcaaagtatgaatcgttttcggattaaacgcatgatgctctccgccatttctccattggaagtcacttcccggttcaagcgttttgctgtaatcatcctgatacgcttcccggtggcggcgctgtgcctcttctgcaattgtttgtaaatcgatgccgcctagctgtgatgcagtacctgtgaaatagcggtcgatcacatcgcggctgattcctaccgcctcaaagatttgtgcgcctctgtagctttgcacagttgaaattcccatcttggacatcacttttacgacgccctcagtaatgctttttccatatttgctgaccgcttcctcatagctgatatccaaacggccttcatcaatttcctgcttgtaggtcgcataagcgagataagggttaatcgcatctgcgccataaccgattaacgctgcaaagtgatgcacttcacgtgcttctcccgattccacaataatgctgaccttcgtacgcagccctttgcggattaagtgctggtgcagtgcgcttactgccagaagcggcggaattggtgtcagtcgttcgttcatctttttgtctgataaaattaacaaacttacgccttggctgatggctttctctgcctgtgtgaacatgtcctttaaaccgcgttcaagatcctctgaaaacagcacatcaattttttggctttttaaatcaggatgaacaatcgttttcaatgcgtaaaactgttcattggataaaacaggtgtatacagtttaatccggcgaacatttcgttcacttggatgaagaagatcgccttccgcaccgagccaagtcatcgttgaagtgacaagctgctcacgaatcgcgtcgattggcgggttcgttacttgtgcaaacagctgtttaaagtagttaaacagcgattgcgctcggtcagaaagtacagcaagcggagcgtcattccccattgaaccaaggggatctttgccttctttaataacaggaattagatacttttggatatcctcatatgtgtatccgaatgccttctggcgagtaagaagatcactaaattgttcttcttctcttgactccggatcaggatttacttgtacaagctcttcttcaagccatttttggtacggatactcagttgcaatttgtgttttgacttcctcatcggagataatacggccttcttccaggtcgattaaaagcattttcccaggctcaaggcggtttttatataaaacgttctcctgttcaacttcaataacgcctacttcagatgagaaaataatataatcatcttttgtgacataataacgggccggacggagaccgttccggtcaaggatcgccccgacttgtttaccgtcagtaaatgaaatagctgtcggtccgtcccaaggctccatcagggagctatggtactcgtagaacgcccttttttccttggacatatgcgtattttccgtccaaggctctggaatgagcatcattgccgtatgtgccggtttgcgtccagccatcacaaaaaactcaaatgcgttatccaaaatggaagagtcactgccatcagcattgagaatcggcaaaatcttgtttaagtcctcaccgaagctttcagaaacaaattgttgctcacgtgctctcatccagttgatatttccgcgaagggtgttaatttcaccgttgtgaaccaaatagcggttaggatgcgctctttcccatgtagggaatgtgttggtactgaagcgtgaatgaacaagcgcaaaagcagaaacgaatgcttcgtcttgcagatcagaataaaatgcatcaacctgttcaggtgttaaaaggcctttgtaaacaatggtctggcttgaaaaactggcaaaataaaaatcaagaccttccgttactccccaattttcagcctgtttacgaatgacatacaattttcgttcaaaagataaattgtcctttagatcagaacttgcgccgataaatacctgacggacaaacggacagcttttttgcgccactgttccgatttttccgacatttacaggtacagttctccatccaagaacgacttggccttcttgttcaattagtgcattgatttgcttttcaattttttttctttcatcttccttctgtgagaaaaagaccattcctaccccgtaacgttctttttctggcagattgatgtttttgcactcttttctaaagaaagcatcagggatttgaaccagtaagccggctccgtctcctgtatccggatcactgccttgccctcctctatgatctagctggcaaagcatcttaagtccttgtttgacaatgtcgtgagtctgcttgccctttaagtgtgcatataggccgattccgcatgcatcatgttcaaattcaggacggtagagaccttgagcttttggcatttgattgtacgtcataattcctctcccccgatcaatttccgataataccggtcataaaatctaacaactctataatcattgtaggttttcaaaacgatataaacaatatataatttagatcaaaagaatctcaaaatgagatagatggatgtgagacaaacatggagctgcgccaactgcgttatttcatggaggtggctgaaagagaacacgtttcagaagccgctgatcatttgcatgtggcccaatcagcaatcagcagacaaattgccaatcttgaagaagaattaaatgtgaccttatttgagcgtgaagggagaaatatcaaactcacgccaatcggaaaagaatttttgattcatgtgaaaacggcgatgaaagccattgattatgcgaaagagcaaattgatgagtatcttgacccgcatcgcggaacggtaaagatcggctttcctacaagcctcgccagccagcttttgccgactgtcatttcagcgtttaaagaagaatatccgcacgtcgaatttttgctgcgccaaggctcctataagtttctgattgaagctgtcagaaaccgcgatattgatctggccttattaggaccggtgccgacgaatttctctgacataacgggaaaaatattatttactgaaaaaatttacgcgcttgttccattaaatcatccgcttgctaaacaaaaaacggttcatttaattgatttgcgcaacgaccaatttgtattgttcccggaaggatttgtacttagagagatggcaatcgatacttgcaaacaagcaggctttgctcctctcgtttccacggagggtgaggatttggatgcgatcaaagggttagtgtccgcaggaatgggcgttacccttctgcctgaaagtacttttgctgaaacaacacctcgttttactgtgaaaattccaattgagttccctcaagtaaaacggactgtcggaatcattaaaccgaaaaatagagagcttgcgccttctgcgaatgatttttatgagtttgtcattcaatttttctctaagctggagcagtatcaataaaaaaatgaacccgagcttctatatagaagcttcgggtttttttctgcaaattaatttacaggtaaagaaaaatccacatggcaaacaaaggcttcttgatcaattagagctctgtttgtcagttccttgttcttttccggttcttgaagctgtacagaagagtaattgacgattccaaggccgatttccgtcccttttgaatccattagccgaacaactgaaccgcttttaaatttccctttaatcttctgtacaccgtctaggtataaactcgattggccgtttgttatttttcgtgaacaatcatctgataaaatcatttcaccttccggaccggaattaaaagcgatccattgctccttttgattcaacggaagcgttccttctgcttcaaaataggtgccttccgcctgttcatgaacggcgtgatataaaatatcgccgacatctgcctgacctaggaaacctttaatgccagacgccattacgattttaaacgcatcaagcttagagcgcatgccgccggtgccaacgatgcttccagtgtcacctgcgcatgcttcgatgtcaggtgttatttcactcacccgctgtatccttttcgcttctggatttgtgcgcggattgccgtcatataatccgtcgatatctgataaaatcacaagcatatctgcatcaatcaatcctgcgacttttgctgcgagcgtatcattgtcgccaaacttgagccgattgacggtaactgtgtcattttcgtttatgatcgggatgatgccgcgctcgagcagtacattcattgtattcctgacattgttgtatcgatattcatcagaaaaatcgcttctcgtaattaaaatttgggatgcgacatagccgtgtgccaaaaacagctttgaataagcctccatcagcaatccctggccgattgaagctgatgcttgtttttctggaagcttctcgggcctttggataaatccgagcttccgatatcccgccgccactgcgcctgaggaaaccaaaatcacttcatttccggcgtctttgagtttgacgacctggtcgaccagcgcttctaatttacgaatgctgatttctccatgaaggcttgttaatgaactgcttccaatcttcacaacgactcttttcatgcttgtatcaggcgtcactttatcactcctgatagcggcgctgcagttttttcgatatcttcgctgatttcctttgaacgcttagccgcatgctttatcgcttgagaaatcgcttctccgccgccgctttttttcaaggcttgcagccccgctgctgtcgttccgttcggtgacgtgatattatctcttaagatctcaggatgttctcctgtttccatgagcatttttgcggcacctaaaagtgtctgtgcgccgatgcttcgagataactgtttatcgaggcccgcttcctcgcctgtcttttcaatgaattccattaaataataaaaatacgcggggccgctgcctgcaattccggtgaatatatccatttgattttcttggattgtatagacttcgcccatgcatccgagcaatgcttcggccagcttcttcaggtcttccgacacatatttgccaagggcaatagctgttgcagaagcgccaatcatactggaagtgttgggcatcactctgacaaccggctgttcattaagcaatgattgttcaataaaagaggtagttatgccggcaaggaccgacaatattaattgatggggttgaatacgtgattttagtgatgacagagcgttttcggcgtcttttggcttcattgccaaaatgagcacatccatgtcttcaatacatagttggttcggcaaggcgcctttaatgccatattgaagttcaagttcagttaatcgctctgtattgctgcggtttgtaacgcagatgttttgtttcgtgattttgttggcacgaacgatacctgatatcattccttccgccatagatcctgctcctataaaggctactttcttttgatcaaagatcggtaacatctcctttgttcgcttttttgttcgcattttcacacgtttaaaatgttaccacgtgaggaaatgatgtcaagtttgaaggtcatcattgatttgtattgtttcttttcgacaaatatgtataatgaaaagcagaaaacacccggttcacactgctgcgccgggtgtttgtttctattaaaaattatctgagagggctttttcaatcagttttttacagcgatccagctctaccttcagctgttttttatatagcttggcggcttcgtaatctttaaattgatagaggacgacttcctggagcttagccccttctttttttactttaatttgttttagtatcccgtcatcaagaagctcatgcaaagaccggtatacttctgtatgatttggtttaaaaccaatctctttaaattcagaccgaagtacttcaagcagctttaacccatagagtctctcttgctctgtcatcgttatcatataaagcttcaaaaatgcgcgctgtttcactaaaaagcctgttgaactccttttttcttctttcatcatatgcactccttcttctgtcactgacaacactatgtactaaatattcaattttcttttattgttttccttctttatattaaagactgatagtccagttatttcatgtttactgattataggtgtagcggaaaaaataaattctgactgaacatttggtacatagttttcttagttctattatagcctacattcactgccagcttcaatttaaaacgattgtcagatttgcatatgccggtatgaatttcattcaaataaaaaaacctgtcgaaagacaggttttcatttttaaggatttgttgaccataatcccgctgttttgatgaaaatacgaggatctaatttcaattgtgccaccatgtactcagcaagatcctcaggctgcatcactttttcaggattaccgtctgttaagttcaattcgatagacatatcactagcgacagtgctcggcgttaacgcgctgactctgatattatgttttctcacttcttgcataagagactctgttaacccgagaacggcaaatttagaagcgctgtaagcacttgttacagcagctcctctttgacccgctgtagacgaaatattaatgatgtctccggctttgcgttcgatcatttccggaagcaccgcgcgcgtgacatggtacacacccattaggttgacttgaataatattttcccactcatcggctgacagatctaagaaaccgccaaatttgctgatgccggcattattaatgagaatatcgatatcaccgagctgttccttcacttgagctacagcttggttaacctgatcggcatcttttacatctgcagcagcaaatgcagcttttacaccaagcgctttgacttcttcagccactttttctacattagcggaagtccggccaattaacccgatattcacgccttctttggcaagcgccaaagcagtagcgcggccaattcctctgcctccgcctgtgattagtgcagttttatgttgtaaattttgcaattgaagcaccctttctttgtttacatatgtacgttatcacattataagtacaatacatccaatacgcaaatcaaacgaactgtgtaaatatcatttcttctgattaaaaaaacggatacagggtaatgacataagaaaaggagtgaacatatgattatagtttatatcagtcttgcagtattagcagtttctattatcttcttaggagttaacgtgattcaaaacaagaaaaaaatggaccctgcactaaaggagctttcctctgttacgcaggctatgcaaaaacaaatcgaaggattaaaaacagaaacagatctgctgacgcaaaaacaaaagaagattcagcaggatgtccaaatgaaaaaatccgcgtttcagcagaccgcagctgaagtaaaagaagttcctaaagctgttaaagaggtgtggcaggctggtcatttaaatagcaggtcatgatgaatgatatcccgttgtttcgatcagaatggacaatgggatatcattttttgaggaggctttcgcatgattgtaaaccacagttgcttaaaggagttcgcagaaaaactacattctcttccctcttcacttacaaagtcggatttacttatttctccatttcatctccatcaagaaaatgaacttgacatctactattcacctcataatgaatatatcaatcggactgctacgattgtgattgccgggatcacgccgggtttttcccagatgaaaacagcgtacgaaacagcagtcgaaagtctgcggcaaggccgcactcttgagcaaatggcggtagatacaaaaatagcagcgggtttctccgggtcgatgagacataaccttatcaccatgctggatttatgcgggctgccgcaagctttcggcattcaaagcgccgcaaagctttttggagaattacggtatatgctccatacaacttccgttattaaatatcctgtctttatccagcaaaaaaactataccggatacaaaccggctatcactcattctcctatcctaagcacctatgcttttgggcacttccctgcggagcttaaccatgtgacgggaccagctcttctcattccgttaggaaaagcggccgaaacagtatgtgaaacattgatcagacaacacagcctccagaatttgatttgccttaacggctttccccatccatcaggcgcgaacggccatcgtttgaaacaattcagcaaaaacaaagagcaactagaaacacaaattcgttcctttgctgcattggttgatttcgctatagaaaagaggaaataaaagggatatgataaacaaaaacacaaacgtggggagtggttgaatgtttcctatattagaaacggatcggcttatacttaggcaaatcacagatcaggacgcggaagccatttttgcttgtttctcaaacgatgaggtgacacgctattatgggcttgaaaacatggaatctatagaacaggccatttcaatgattcaaacgtttgctgccctctatcaagaaaaacgcggtatacggtggggaattgaaagacgggacactaaagaactgatcggaacaataggctttcacgctctggcccaaaagcataggcgcgcggaaatcggttatgaaatcatcccggagcattggcgaaacggttttgcatcagaagtcatttcaaaggtcgtatcttacggattttctgcccttggactgtcgcgtattggcgcagttgtatttactgctaatgatgcatcaaatcgtctgctcctaaaaatggggtttcaaaaagaaggtgttttaagacagtacatgtatcaaaatggtactccatatgatacaaatgtgtattctattgtgaaaccaagagaatgacggtattctcttggtctgtgccacatcccttttcctttaaaatgataaaaagcgccccggaaaatgggcgctttctaattaagatgcatattgaggagatgattcctccttaactgctttttcctcaggtatatgaatgcatttcgtcatgattgcactcgcaacgtaaaggaccgcaaagatccagacgacgccttgcgcaccgacgagaccgatgaacaaccaagcaagcgcgggaccgacaaacgctgataaacctgcagccaaattcaatacagacatggctgcccctttatcttttcctgccaccgtcggcacaattgcaccaatcggcacatagcctgccagcaaaccgccccaaataaagccgatcacgctgacaaccgctaagcttccgccggagaaaacaggtgcgtagtataataagagggtgaaaatgccgcagccgactccgccgaaccaaataacagtatttttccagccgaatttatcgccgacaataccaaagataaggttaaacacaatgttccccaggaaaatcgttccccaaatttgcagccacacattggttgaaattccatgctgggccatgtgcatcggcaaaaagactggaaaaccatatgtaccaatgctgttgatgattctgatgattccgcctgtaagcacgcgcggatttgtaaataaaatcgtaaccccttttaaaagctcctcggctgtttctgatctttttcttttcttcttttcaaaacggtctttattgataaacaatgcaaaaaatgcaccgagacatacccagaaaatagagctccaaagcgtattcaaataaccgaacgctttgatcgcgtagcttgagtaccaagcgccgaacacaaacatgccgaggcaatatgctatccaaaaccagccgacagcagtgctcagtttgctttgcggtgttctgtaaatgacccatgtcaagaaagaataagcaaaaagcgggtaacctaacccttttacgaagtaagtcacatacatcactggcaggttcagctgttcaaatccaaatacgataaaagcagctgtaccgatcacataaaacaacagccccataaacatcgttcgttttgcgccaaatgcttcgagacatacacccgaaaaccaggaagctatggcaagcgcaattccgtatatactaaaaatagaagcggactgctgaacggtgagcccgttttcgatcaaaaaaggactgagccagccttgttcaaggccatctcccatcataaacaaaacaacccctaaaaatccccaggcaagccgcttcggtattcctattttatccaacatatctgtctcctccttagatgctaatattcattaccgtattaccttattaaagttgaaaattaaatgattcctcaaaacagcagaaatgccgtcttaaattaatactttgctttctgatcctgaaaaaaagcgctgtgtttgcttccattcctcatataaagccaattctatctgacagtccttcggttcgatcacccggacatttgctgacatctcctccgttaattgaaaggtttcattgcaaatgactgcagcaccgacgacagatgcctgatgatatccctcttggacatagacctttttttgaagaagatccgcgatatattgagtgagcgctttgctttggaatccccctccgcacacccaaacatagtcacgttcaaacggagtaacctctgttaaaatgtcaaagttccatttgattgaaaatgcgatctcttctagcgctgcacgtacaaaatgtgccctctttaaatgtgctgacagcggggcatcaaaaagaaaaccgcctctcgttaacgcattcttttcagccgataaataagagccgagagccgctacacatgcatggtcttcttttgcaagtgcagaaatctcctcctccattacttcgtacgtttcattcggataaaaaatctgttttaatttttgataattcaagccggtaattcccggattcgtttccacaagccaatgcccttgatctgtatgacagttcagccaggctttatgttttgtgtcgccatgatccgcagtaattttggttattggcgttgttgtccctgatacaatgacaatgtcctcaagtccagctccggtgcttttgacagccagctgtgtatccccgccccctgctataaccttagcatttattgaaaggcctaattcggatgcatattcatttgctatcgttccaattgctgttcccgctcttacaagaggcggaaggatagatggagaaaagccgaaaatgtcgcacatctcttctgaccaagtgttttgcttcacatcaaatagcagggtttctgttgcctgtgatggttcatatgttaatattccgctcagttggtacgtcacccaatcactgatgcttgtaaagcttgcagtcttttcccataaagagggctggcgctgttttaatccataaagcttgagcgcagaaaaaagtgcagttggcaggcggcctgtgcggctgtatatctcttcccgatcgggaatgcccgcctcccactctcggccgcgattatcgatgttcggcagcccgagaaaaggattgccgttttgatcaatcaaaacaatcccctgtctttggctcgtcgatgtcaaaccaatgatgtcaatatcacgcgaacgggatagcgcacgttttgccaaattcatcacctgcttccacagcacctgaggagaaaaataacggctgtccgggtaaagcgtctctgtggaatactcgatgtcctcccgttcaactgttagaacactgccagttacactcacgaccgctaccctcgcattgcctgtgccaatatcaaaaacgagatagcctttttgttttttcattctcttagcctcctttcttatacccctgttttcagttcgtccttgttatacattgtcggaatattaagagttttttcacccttccactttttgagggctttattcagtatcgtcacgtgatgatcctccacttcaaatgttgctccagcgagatgcggtgttgccagaacattaggcaatgaaatcaattcataatctgattcctctggaggttcatgataaaaaacgtctaatatcgcacctctgattttatgttcttttaatacagataaaagatcttcacggtttacaacaactgctcttgaagtattgacgaaaatcgcactctgtttcatcagatcaaaatgcttccgatcaataagtccaagtgtttcctcagtacgaggcagatgtacagaaacgatatcactgtctgaaaacaccgttttaagagatactttttcatacagcggatgatcgtcttgaatgtatggatcgtaatactttattttacagtcaaacgcagtcagcagttttgcaatcctttggccaaccgccccgaacccaatcatgccaaccgtttttcctgttaattcatttcctttaaatttgacataagcctgcaggtaatcactgttccactttccatccttcagccattgattcgaggcgctggtatggcgcagaaaggaaatcacatttccaataaacatttcagcaacggcttgtgcattccgccctggtgtataaaaaacaggtatgcctctttttgaggcagctgccacatccacattagagggcattcccctgcaaacaccgacaaatgaaagttcgggaacagaagcaaatacgctgtctgttacctgatcaagttcagtaatcaagcctgtcgcatttgttgcttttagcagctgaatgagttcatcttcccgatatgccctaccttgttccttccaagattgataagtaactgagccaaataagttttcaagctcttttcgtccttcttcgttgtacggtgctgtaaccaaaaccgtcatggtgcaaaacatccttttcattgtatttttcataaaaaaaatctctttccgaagatggaaagagattcatatataggcgcgctctgttacaggcagacgccggtataaaccttgctttcctatctttcaagctgacgcttgctggaattggcacaataatgttgccgaggtttcatagggccagtccctccacctctctggatagaaaatgttgagtatgtaattttcagaataaagaatacatttatcataaagaagtctcagattgatgtcaatctcttttttcagaattgacgttatcatccgaaatgttataattcttacaaaatatctaactagagagaggaactgggccatgaaatcttttgccacacaacaaaacggcattttcaaatccgtttgctcgctggactgcccggatcagtgcggattgttaatacataaaaaagacgggaaaatcgtaaaagtgcaaggagaccctgatcatcctgtcacagccggaaacatatgcaacaaagtccggaatatgacggagcgcatatatgatgaaaagcggctgactacaccgctcaaacgaacaggtgctaaaggccaagcgatatttgaaccgatttcttgggaagaggcaatcgatacgatcacctcccgctggaaagagctgattgatgaagagggagctgaaagcatacttccttacagcttttacggaaatatggggaaattgacagctgaaggaatggaccgccgctttttttaccgcatggggtcaagccagcttgaacggacgatttgcagcaaagcgggatctgaaggctataaatatacaatgggcataagcgcgggaatcgatcctgaggaaaccgttcatacaaaactatttattttttggggaatcaacgcggtcagcacaaatatgcaccaaattacgatcgcccaaaaagcgcgaaaaaaaggtgccaaaattgtcgtgatcgatgtgcataaaaatcaaacaggacgtcttgcagattggtttatcccaataaaaccgggaaccgacagtgcacttgctcttggcatcatgcacattttatttaaagaaaaccttcatgatgaagcatttctgtccgagtacacggttggctatgaagagctccgtgaacacgtgaaacaatatgatcctgaaaaggtatcgacgatcaccggtgtcagtaccgaagatatttaccgactggcaaaaatgtacggggaaacctccccttcttttatcagaatcggaaacggaccccagcatcacgataacggggggatgattgtaaggacgattgcctgtcttccggcgatcaccggccaatggctgcacacagggggcggcgcaattaagcataacagcggaattttagaatataacacaaatgccttgcagcggcccgacttattgaaagggcgcaccccgaggtcgtttaatatgaatcagcttggcagggtgcttttggaaacagacccgccgattcgctctctatttatttacggaacgaaccctgccgtcgtcgcgcccgaagcaaacaaagtcagacagggcttgctgcgggaagacttgtttactgtggttcatgatttgtttttaacggaaacggctgcatatgcggacattgtactgcctgcaacatccgcttttgaaaatactgatttttacacctcctactggcaccattacattcagcttcagcagccggtgattgagagatatggggaaagcaagtctaacactgaggttttccgattactggctgaagccatgggattcacagaccaggagcttaaagattcagatgaagtattaatccgccaggcgcttgaccatccagataatccgcatttggcagagattgattacgatgcacttgctaagcattcatttatgaaagcaaaacgcgaaaagccgctgtttccgggcgaacttccaacgccaagcggaaaaatagaattatattcagaaaaaatgaaacaagacggcttccctgctttaccgacatatacacctcttgtaaccgataatgaacatccgtttatgtatgttccggggccaaaccataatttcttaaactcaacattttccaataatgaaaaacacatcaagcttgaaaagacgccaaagctctttatcaacacaaaagatgctgaagaacacggaatcgttgatggggcacctgtacgaatttggaacagccggggagaatgccaactgaccgctgcagttggagaacaagtgctgccaggtgtcgttgtcagccaaggattatgggcggatgaacaaggaaaaaaacagcttgtaaacgcgctaaccccagaccgattgtccgatatgggcggcggcgccacctttttttcaggccgtgtacagattgaaaaggtttgaaaaataatgaaacccggagtatgccaagcccgtataacataacattgacataatggaggcatacacatggacgtttttttaggaattggtattgctttggcaggatattttatcggtgaaggcttaaagcagatgaaccatccaaaagcatatgaaaaaagtgataccttgcttataaaagaacgagatatttacttttacatcggacattttttaggaataacgacaactgaggcaaaacagttagccggagacatgacagacctgccttacattaaaatcaacgggaaaaagtatgtgcaaaaacaaagtttaatagaatggatatttgcattagtcaaaaagcaacaggatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaagcgaatgaatacctgcctaacagacagaataagaagagttgatattcaacacttttcgtaaaggagtgaaaccaatgagtaaaaagggaattcaaaattcaagtattgaacaaatgagaaatgaccatgagactgaaacagcttttaaagcagatgatcctaaaaaacatggttctgatcctaaaagaacgaaataagttcttacccacactaaaatatcaataatctggaggaagtaaagtgactcaaaaaaacggtgcagacagacctgatgattataaaagattttcttcattagacaaggaatatgattttcagcaatctataagcagcaatactgagacagaaagtgtaaacactgaaacacaaactcataacaaagaaaacaaaaatgacacaacagatgttgccgggaaatactttgagccctcagattataaaggaagcacgcaattagaaaaaggattggctgaaactcatgaacaggtcagcgatgactattttgaagggacaatcgatcaaaatttggactagccatacaaacggagctaacttaaaagaagtcagttagctctatttgtagaaacaaccacagtaaagtagcaaacctccaccgaataagatgggggttgcacgtaagtagcctgtttaatatttaaaacgattaatgacggtttgaagctcttctgccaactgagatagagattctgcggcataggagatttcctccattgaatgtagctgttcctctgatgattttgcaaccgcttctgtatttgctgacgtttcttttgtaccagcagccaatgtatgaactgtgtgctgaatcacttcaacgcctgaagtaagctgttgagttgctgctgcaacttcttgtatttgagaagtgacctgttccaccaggttcagtatttcattgaaatttcctgttgtctcttgagaaagaacaatacctgagctcacattttcttgaacaactttaatattatttaccgtttctatcgattcgttttggatggtcgctaccaccgattggatgtggtttgctgatttatttgtttcatccgctaatttccgaacttcttcagccaccacggcaaatccttttccttgctctccggctctggccgcctcgatcgctgcgtttagggccagcaaattggtctgctctgaaatcgtcgtgataagcgaggaaatatcactgatttctgctgtgctcgctaccaatgcctgtaatccattgccggctgaatctacagatttatcaatgaatttcatctgatctaacatcttgttgacggacttagagcctatttcagccttgtctctcatcgaagaagaaagatccgctatgttccctgtatttgaagcaacagatgatatactgtctaataattcagtaatggattccgcactcttttctgtcattgagctttgtttcacattgctttcggcagccatctgcatggctcgggaaatatgttcagatgttgatttcgattcttccgcgcttgccgataattcttcggaggaagcggcgacttgttcagatgaactgctgatttgcttcacaatttgagataatgaatgagtaaaagaattaaaagatttggcaagctggccaaattcatctttatttttcactatgacttttttggttaaatcagcctcgccatgagcaatttcctctagctgcttatttatgcttcttagtggcaccataatggactttaacagcattatgcttagaacaatgcctaatattactgatatccctgtgacaatgataatgagcgattgactcattttaccattgccctgtatttcatcctttagatcctctacctcttgatccaggcgatcagacagcttattgacagccggatctacgacttcttttcttaatgttctttcttctccaaaatgaatggtttctgcttttttagaatttgaagagtaggctgttactacctgctgattcaaagctctatactgagtaaaacttgtcttaatgtcttcaatattggattgatacttctcttcatcaatcaagtcattaacccggtcaaggctctttaagacatcgtctgctttttccttcataccctcgtcgtattctttgtctccggtaatcaagaagcctctttcatcatttgataacccggtcaattcatattggatgtgttttatctctttttggaattccattttgtctttaagttcttcattctttttcacagtagaagaaatcataaatactgaggaacctccaattccaataattgaaacaactaatattgatataatccccagcaattttgttttcactttcatgtgtcgttttccctttccgcacaatgtaatggctgaaataaaatatgttcaagcgcgtttgaatccaattcgcttacgctcatgtccataatatcgacacgtgttatcaagttttatagtgctattttcatatgaataagcaaattctttacggctctaaatcttcagaaaggcttcacgaaaaattgactgtcttttgtcgtataagtcactcttattctcattttctaaaaaaggcttttcccacctcaaattggctgaaccggctgttttctcgaaaatataatacaatacgcagcataatatgaaggagcgaaacttaaatggggatcatcaatggtaaagaattcattgaccgattgaataaactagaaaacgaaatatggtatgatggcgaaaaaataaagggtaacatttctgagcatcctgcatttaaaggaataatcaaaacaaaaagctcactttatgaattgcaaacaagggatgagttaatacatgaaatgacttattgccttcctggagatcataatcgaatcggcctttcctatctccagcctaaaaccaaaaatgatttgaaaaaaagaaggaccatgattgaacattgggctagacatactcacggaatgatggggagaagtccggattacatgaatacggttatgatgagctttgcttcgtcagcggagcttctaaaagataaagagaattgctttcctgaacatatactagatatgtatgaacaagctgctaagcatgacctttcttttacccatacattcattactccgcaagtgaaccggtcacagtcctattttgggctaagtgaaaaaccgatatctgctaaagtcattgatagaaccgaaaaaggtttaatgattcatggcgcacgactgcttgcaacacaaggcggattgaccgatgaaatcttggttttttcagcgcctaaatttttctttgaaacagatgaagcttatgctttttcaatcccttctaatacaaaaggcgtaaaattcatcacaagagaatcatttgtattaagcgactcttcctttaatcatcccttaagctcaaggtatgaagaaatggattcaattgtggtttttgatcatgtgttagtgccgtggaatcgtgtgtttttttacgataatgtggaagcagctaaagattttatgacaaaaagctcttttcatgcctttacctttcaccaggttgtcattaggcaaatgataaaaattgaatttctattaggtgttgcacagcttcttgtcgacaccattaatgtttccgaatatcagcacatccaagaaaagctctcagaaatcattgtgggattggaaacaatcaaagccctcattgacaaatcggaaaatgatgctcagttagatgaattcggctatatgcgcccctgtttaattcctcttcaagtcatcagtacgatcattcctaagctatatcctcgatttactgaaatcatacaattaattggagctagcggaatggtgacactgcctaccgaaaatgcatttgactcagagatacgggaagatcttgaccaatatcttcaagcaaccaatacaaatgctgaagaacgtgtgaaaattttccgtttggcatgggatttaacaatgagttcattcggaactagacaaactcactatgaaagatactttttcggagatcctattcggatttcaagcaggctgtataccagttatccaaagcaggagcagttgaacatgattaaaacatttttacatgcagatgcagaacaatgaaaaaacagcgggaaaagatccgctgtttcgtattttttattcaggaaactgaacatggcccggtactgtataggctttggacgttccgctttcaggcagctttggaatggtgtctttcacaacttttccgcggatgtcagtcattctgactttgagagagcctgtacctaaattcgtactcacaaaatggttatagtccattttctccatgttgatccacttaccatccttttcatattccattttcataacaggatacttgtgatttctgacttggattgctgcccaccacctgctgctgccttctttgatccggtacgtgaaattgccggtgattggggctttgacaacacgccatttaatattgatttttccgtctttcatattgccgattttacggaaggcattaggtgacagatcaagagctccccgagcgccttcgggataaagatcagtaacatatacggttgttttcccttttggcccttcaacttccaaataagagccggcaagtgctgcttttactcctccgtaattgagatccgccggatttattgcagtaatctccatatcggaaggaatgggatccagcaggaaagctcctcctgaataacctgaccctgtatacgttgcataaccttcatgcaggtcgtcatatgctgccgaagcttgcggcgaaaaacagaagatcgtcaacaaaaccataccaacaaatgcactcatgatctttttcatatttggtcctcctcaaaccagacttcaaatgagaatcattatcattataagactcaatccatctggtttgaaagaggaaatagattcatagatgattttaaggcaaattcactatcattcatatatcaaatgtaggtacttatgaaaaagccaatacaaatgaacgaatgtgcacttcagccgaatgtcttatttttccctctcaaaattcgcattacaataacgaaatgaaacaggctgttggcctgataacagctacacaggaaaagctatttttccccgctcagtttcaacttagctgtcatcataatgccaaatatcagcacaatcggaacccaaataatgaagtgataaaaatcaggctcagccagagcaacaataatagcccccacacaatacaaaataatagccagtgctcttaacacagtatctcttaagaaagtcttcttttgcttcttaaaaaacaaacggccggatatatcctctaaaagagaagccaaagtgccggtcaacacagttgaagaaatacctgcgatccccagtttttttgctgctgtagtttgaatccccatagaaatgctcatgagtataatcagaatgtgcacaggaacaaatgcccggtaaaaagaaagacaagcaaagacaaacaaaatgaatgcttcaagtgcgagggcttttgtcacagcagaaggccaaagggtattttccgcctttccgaccatcaatgtagcaatgatcacgccgcatataaatccgattagcgcagtcaaggaattaaaaacagtgacctgaatggatttgccgatagctaaccccaataatacaatgtttccagtcatattagctgtgaacacatgtcccaggcttaaatacccgattacatccacgattccagctgttaaacataaaagtgatagcaaggtgtttcgataagctgctgcagtcaacggtgtatcaatcctttcttctatttcaattgttagtatgtcttttggcgcaatctctattttttaaataacccaacattaattaggaagatagaacctatcattcctttccattaactgtaataataatccccgcaaggaaattaaaattgaaaggaagcatattgtgatgaaacgactttgtttatggttcaccgtctttagcttgtttttggttctcttgcctggaaaagcattaggtgcagtcgattttccgaatacctcaacaaatggccttttaggttttgccggaaatgccaaaaatgaaaaaggcatcgctaaaacgggcacaacgggtggaaaaaacgggcagattgtttacattcaaagcgtaaatgatttaaaaacccatctaggaggatccactccgaaaattttagtgcttcaaaatgatctttccgcatctgcgaaaacaacagttaccattggctcaaataaaacactcgtgggctcttacgcgaaaaaaacgctgaaaaatatttatttaacaacttcatcagcttctggaaatgtcatttttcaaaatttaacgtttgaacacagtccgcagattaacggaaataatgatatccagctttatttagattccggtatgaactattggattgatcacgtcacattctcaggtcatagctataatgcaagcggaagcgatttggataaactcgtgtatatcggaaaatccgcagattatatcacgatcagcaactcaaaatttgcgaatcataaatacggtttgattttaggatacccggatgattctcagcatcaatatgacggctacccccacatgacaatcgccaataattattttgagaacttgtatgttagaggcccaggtctgatgagatacggttactttcatgttaaaaacaattacagcaataattttaaccaggcgattacaattgctacaaaagcaaaaatatattccgaatataattactttgggaaaggcagtgaaaaaggcggcatccttgacgacaagggcactggttatttcaaagacataggcagctatccatcactcaacaagcaaacctctccgctgacttcttggaatcccgggtcaaactatagctatcgtgtccaaacgccggaatatacaaaagaatttgtcacgaaatatgccggatcacaaagtacaactctggtatttggctactgatataaaagaggccatgcgttaaaaacgctgtgcctcattttagacttataggctatttttaagcgatccttgtaactccatcaagatccagcgtcggtccaaccaaaaagcatatgttcttttccacaataacttcttaactggctttcttattataccagtatatctcaagtgaaaagaaatcattgttctgaacctgtattaaatgaacgttcgtccgacaaactattcaaaaacccctaaaaaggatgatggatatgtgcggcaggtttactttgtactctgcatgtgatgatattattgaccaatttgacatcgatcaattttttcctaaaggtgaataccagccaagctataatgtcgcaccatcacaaaacatccttgcaatcatcaatgatggatcaaataatcgcttaggcaagcttagatggggacttattccaccttgggcaaaagatgaaaagatcggttataaaatgatcaatgctcgagccgaaacaattaccgagaaaccggcctttcgaagaccgcttgtcagcaaacgctgcatcataccagcagacagtttttatgaatggaaacggcttgattccaaaaccaaaatcccaatgcggatcaaattgaaatcatctgctctttttgcgtttgctggcttatatgaaaagtggagcacacatcaaggagaccctctttatacctgcactatcataacaactgagcctaatgagttcatgaaagatatacacgaccgaatgccggttatattggcccatgatcatgaaaaggagtggcttaaccccaaaaatacaagccctgattatctgcaaagtttgctgctgccttatgatgctgatgacatggaagcataccaggtttcatcattagtaaattcacccaaaaataattcagctgagcttcttgatgcagaaaatcatatgtagtgattgaaattctctagcaataacttgtcaaatagctttgttccttaggtgccaatccctctagtaattatgaatatttagtacatagatcaattagttattttagcatcagtttgaaataattttattatgtaaacttaaataagcgatgttatccctttcatataaaatagtttacatttttataaaatcgcttcacttttctattttgtcagtaaaaaaactgaaccacattaaacttatgaaacctgccgcacctgtgattgcaaatatgatataagcccatagaggtaaatccatacactttccctcctaagaattaaatgaaatttctttcatcttacatgaaggtcttctttcttttgtttatccagtgtaatacttaataatatgttgatgaatgcagctggaaaatatataaatcccactccaagaatgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcagaaaagtttccatcatcgaatacgagcagaaactcgcagtgttccaatccctgtatggaatgcgggattcctgctgggaagtaccaaaggtcgccgggaccaacatcagcaatgaaatttcgtccgtcttggtcaacagcggtgatacgtgcccgtcccaaaagcatataagcccactccgcttgcttatgccaatgaagctcacggacgcctcccgcagttaagctcatgtttacacctgcaatcgcagtcgaaatcggaagctgtcttacggtgatttctcttgaccagccgccgtgatctaatttcatgggagcgtctgagaatgaaaatctcaagttaggaatcataccctcatctgtgacaggcggaacaagtatattcggattttgaatatcccgtattatatttcgcgggcctgcatcaatagctccagctccatcacttcgaataggctgcggcacgtttctgtcttcatgattgattggttgttgttccaacagcatgcacctcgttttagaaatgaacaagattttatttcagcctatgcagaatcttagattgctgtgcctaggaatccgcaaataaaaaagtgaccaccaatgtgatcacaaatacagcgaataagctattttttataccatggcttcttatgtaatttgatttcttctgtctgttttttctggcctgtcctccactccacttttactaatacatcatgtcctatcacttcatcttcaggcatataatcaaaggtggcaatatggtcctccatgcgtcccccacctggcatttcatcacctgtgtactctgataagtcgtactcatctacgttatcatcttgatacttttcgccatcaacatacagagtaattctttcaacaacagtcctcttttcgtccttcttactcccctgccaatacagatttagaaaataattaggtccaattgaagttttgtctgatttttcaaggttagacatccacagtccgcttttcccgctgccctcatatttcactttgtttcctgataccattacaaataatgtggtgatgcagatgatcaagaatccagcaatgatcaatagccatttcttaatattgttcttttttctcatgcttttccccacttccctaactctttagtaggaaaatatgatcaaaatgttactgaaaagaaaataaaagagctaatgatctaacagatgactgtctaaacttttgacttaaattaaagcgctctctaaagacaagattaaaacgtataacagctcttttgtttcactgagtcaagaaccttaaaatggctttttattattaaaaatcaagctagtgtattaagtaacttttcaaatttatttatactcatgatctcgtgagtcacaaatctcccatcaaaaaaacgctaaaagttgtccaaatagctggtgacttttgttcctcttcttttgatgataactgaattgactgaaattgaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaatttcgaaattaaagatttttaataatgaaacgggctgcacttgtttaggtgtcactgtcattatcagtaaaatgttacgctgaaatgcgcagtcattcacaaagtctctattcgtatttcataaagactttgtgatcatcgagaaacatttcactcccatcggataagtgtatccaaaaagcctcctctggttcttctctatagtcataaatcacagtcactttgacatttgactcagctatgattggttttccaacaattattttcgttttttcctcaggcaaagtaagagatcgaatcatcaaagccattccatctttactgtctaattaacgccatcttcagtgaatttaaaggtctgttttaaattgcgtccttcttgccccttctgtgtccaaataatgagaacctctaattcagaggccttatctgccagcataaaatgattgaacttcagcggtgagccatcatttaaactttcagctaacattttagaatcttcttttggtttgtcacaattttcatcgaggcatccaaaaagtgaaaatcttgtgattgaatcaggatcatttctatacaattgcacatccactgtagctgctttttcccctatatttttgacttccaaggaatatacttgatattctcctttttgaggtctcgcaaattcctttacattttttgcttcacttacttttactgaccactgttctgttttttgtgtaataggcaacaccgtaaaagtcagggcatgcgcttttgattggcaaaacgtaaatccaactgctgtaaaaacaattacagaaaataatacccttttcacttcatttatccctccttccttttcactggccgttccttaaagaattgattttgagcaatctacaagctctcttaaccaaaaccttacctgaggtttgtctttactgctctgcatttatttctttcggtatccgagatggagccttggggatttttctcaatttgctgtttatcacatcagaagagtatagcgtaataatcatacttcccccatacctttttgcccgaattaagattggttggttatattggttttgaaagcgaaagtcaggacctccccagcttaccgtcgcatcccgtccgggcggtacatatggtacacttctagtatgagaatagcgctgaacgatctgcagtcctgcacgatcgactgcattaaatagagttgaggacacctgacaaattcctcctcctacaccttcagacaactccccttttacaataatgggtgcacttttatatcctttgttccgagttctcattcccacaacttggttaaacgaaaacgtctcattagggaaaacaacgtgattgtcgattgcttttgcagaaagagaaatattgtgtgaacggcttttattgcttgagttaaaatatgtcacgtactgaccaagctgctgcgtactgatgtgagctagcagctcgctgtcaactttcggataaatgttcatttccggcacttctatcttggagggaccttgcccataaaaatacgcataaaacttttccataaacgcctgttgatacagtttgtagccaaccctgcccgggacgatgcttccatgatcgttaaggacagcatttatcggctcacggtacactttctgatcaagctgtttgatgaatttactgtatttttcatagtcaaccattggagtgccgggaagaggcattgtaaagtcttcacggttaacagtggcaatcgtccgtccttgctgtgtgatcgttaaactgtcctgcggctcactcggctgagccaataaaaaaagaccagtgatcaaaatttgtatcataagtcggtttacctcccgatcattagtatgaacagccgcttatcctttgatgtatttcttcccatcgtttgtttgaatctttagacgttgataaaaaccttcataaaagagcttagctttgttcacaccgatccctgagctcactgaggcacacggttcattcagtcggcaagtttgaagtagttcagcatctcccagtgatgagggatgcttttttgtcttgtcaaaaatgaaaagggtctcctataacaacaaaaaatcaattcatttcaatatttttttattgagaaacgataaattttttgttacattcaattagacaacaaataaatgaggtgcttgttatgaatcgaatgtcgacaatttttttaaagatagctttggttcttattggaattccaattcttgctttatgcatttttttagtgcctaagatagccaactattcagcagaattatttccaaatatcgcttatataaaatatctcgttttcatctatttgtatgtaacggcgatacctttttactttgctctttatcaagcgttcaaacttttaagctatattgacaaaaacaaagctttctcgggtttgtctgtaagagctttgaagaatataaaatattgcgcagtcactatcagtatcttttacgcagcaggcatgcctgtcttttatctgatcgccgagatagacgacgcaccgggtatcattgtgatcggattggttattatttttgcttcaatggtgattgcggtctttgctgctgttcttcaaaaactgttaaaagaagcgatagatataaaatcagaaaatgacttaacggtctgaggtgatgacatggcgattattatcaacattgatgtgatgcttgctaagaggaaaatgagcgtaacagagctttcagagagagttggcatcaccatggctaatctttcgatattgaaaaacggaaaagcaaaggctattcgattatcaactttagaagcgatttgcaaggctttagaatgtcagcccggggatatattggaataccgaagtgatgaagccacacaggattcgtaaaaaaatatgtaagatcaacagaaaaataaagtgattggcggtgagcttatggacataaacttatatccatctagctgctatactaagcgtcccttccatacacgaagaacacaactatggaggaggcatacatcatgagagcaataaaacaaatcgttcattttggctgggaacaagccctttcatgtttgtttcctgccgttatttttgcctctttggctattacgcaaatcatcccactgcccttcttgccgcgatatgactggctgctcattatctgcgttctcatgcaattgtggatggtgcgttccggtcttgaaacacgggatgaattaaaagtgatcacattattccaccttattgggattgctctggaactttttaaagtccatatgggctcctggtcttatccagaagaaggatactccaaaatatttggagtacctttgtatagcggttttatgtacgcaagtgtagccagttatttgtgccaggcatggagaaggcttaaggttgaactgattaagtggccgcctttttttgcagttgttccgcttgccgcagcgatttatttgaattttttcacccaccatttttctatagactttcgatggtggttatctgggcttgtcatcattgtcttttggcaaacatgggttacatacgaggtgaatggagctagttaccgtatgccgctcgcactttcttttgtactcatcggattttttatatggatagcggaaaatatcgctacgttttttggagcttggaaatatccaaaccaaatcgatacatggagtctcgtacacctcggaaaggtaagttcatggctcttgctagtgattgttagctttcttatagtagcatcattaaaacaagttaaggagcagagtcccacaaaggcagagatggatgaatctttttcttagcattctaggtcccaaatagagtgaaaagcaacgttcaaatggttgcttttttcttttatgtaactctgccggtgagtattcatcttcttcaaatttcatcgcaacacgataactgattcagattacaactgctttcaacactttgacaaactcatgcgccgccggcgttatctcttcaaatgaatgtgcgatgacgccaatatcgcgtgtgaccctaggaaagatgtcctttttaatcaattgatgcgggacggatgaaagtgtaaagtttgaaatgatgccgatacccaagttatttttgaccatattaatcaaggtttcagcattttgcacagttaagttttcctttaattcaatgttgtattgcgaaaatgcgtttgacatcgcgatttcatgaccgcctttacaaaaaatgaggtcatcttgatatgtttcaaggtcgacatgcttttcaagttttaattcgtcacgctgcggcgggataacggccaccatatagtcgttacacaatagctgattttcaaacggttcaaatggagatgctgcgatcccgatatcaaccgtccgatcttcaacccatccttttatttggtcagaggttccttcgatcaattctatgcggatcagcgggtagtttgatctgaatgcagcaatcgcctgtggcatgatatttgttgaaactgcaggaaatgaaccaattttcaccttcccgtttaacagcttgttttcccggttggctacttgatatattttgctttcaattcccttcatttgcctcgccagcagcaaaatttcttttccgatgtccgtcagcattaaaccatgatgcttatccctgatcaataatttgagctgcagtgagctctccaggttttttatcgctttgcttaccgccggctgagagatgaacaattcttttgccgcttctgtaatattcaatttctccccgacttttataaatatgtgaagatggttcatgttcataaccatttggttatacccccgataataaaaatgtatttcagttataaataaatgtaacatatgatagaaaccagcacgttatttaaacaagaaaggcggcttcattatggtaaaagttatgctgggaatcatatctgtcacacttatttggggttatacttgggttgcgatgaaagtaggaattcatgacatccccccgcttttattttcgggtttgcgcctgttcatcggagcggttcctttatttctcattctcttcatccaaagaaaaaagcttacaattcaaaaagaacatctcaaaagctatatcatcatgagcctcttgatggggctgggctatatggggatcttgacgtatggaatgcagtttgtcgattcagggaaaacctctgttttggtatatacaatgcctatatttgttacggtgatcagccattttacattaaacgagaaaatgaatgtgtataaaacgatgggactggtctgcggcctcttcggactgttatttatatttggaaaggaaatgctcaatatcgatcaaagcgctttatttggggagctgtgcgtacttgcggcagcgcttagctggggaatcgcgaatgtgttcagcaagctacaattcaagcatatcgatattattcacatgaatgcctggcaccttatgatgggagccgtcatgttattggtgttttcctttatatttgagccggtcccttcagccgagtggacatatcaggcggtgtggtcattgctgtttaatggcttgctttccaccggctttacctttgtcgtatggttttgggtgctcaatcaaatccaagcgtcaaaagcatccatggcattaatgtttgttcccgtattggccctattctttggatggctgcaattgcacgaacagatcaccatcaatattatcctcggcgcactgctgatatgttgcgggatttttatgaatacatttacattttcacgacggaaagtgtgaatgatatacatttcccctgtcatttaggcttcatgtgacaggagacgactattacgagaaagtcttctagaatcctgacgacagcctattaaacaatgaaaaaagctaatgtctgcatgtgagacattagcttggctggcgtttaggctggtgagaatctagattcttttttattaccattctggctgatcaaactgaaaaccgtatagaccttttactttaacatctccgcaatctggatcttttgtcaaaatcaaataatgagtcttataaggcatcgtctcaactcgatcagttgcactcaaatcaaaatgatcccctgagaagtttttttcactaacggttatttcatatcctgacaaagtcattcgcatgattcttgcgttaattgtacatccttcagtatcgaaaatggtgaatctgtacccaaagtgagatatccaatggtttgaatttaggtcatcagacttcataaaccatttttcattctctgtcattggaaaactcactttctcctcatctttcacgataacggccgaagcttcccctacatggatagtcaaagccaaaagaaatgtaaaagctaacatcaacatctttttcaaaagagttcctcccaatatctttttacttcaatatattggaagggtcttttctgatcaagacagtcttctccaaatgaatctttagcatcatgaaatgagccttaataagaacagttttaacccaaatcaacctctattcgaaataaggcttaccaatctatattctttttaaaagtttctgcatttctttatatagctcctagacacatataaaaaatgctcccataagttcaggagcactacaaaaaactgctaaaatgttttctatcgatttattgtattcattagctcaaagaagtattcaggcttttgagtcttatttagcttataccatgaacgcaatgtatctggtgcaaatacatctaattttttcaatacttctaccgcaaattccagaggagcaattcctgatgcagtaaccaaatttttatcagatactgctggttccttttcatatagtgtttctcctttgtaattagggcagaccattttcatatactctaagtcattgcttgtgtgctttctcgaatttaagtatccttcattcgcgaggcccaaggttgccccacaaattgcagcaatagtcgtgccgagctttaaagcgtcgccaacttttttcaagatcggctgatgaatatcttctccccaagtgtttcctccgggtaaaatgataagatcttgactcccaagagtacattcgccaagagaaatatctggttttatgcttaatcctcccaacgtagttatcatttctttattaacccctactgtaactacttttaaagatgctgcatcttgtttaaagtatctccctgagtttagttccgcaattaaatatccatattcccagtctgacattgtgtgaaatacgtagagataaacttttctcgtttgcatccaataacactccaatcacaattgataaagctttctaatagatgactttgctgacagccattgtcagcttttttgttgattctattcttatgcccttgttctctcaacttataaaaatataagataaattgattctatgtttactagcgcaaaggggtttgttacactaactgtcatgggaaacatttcaaaggtaatacaaaatcatttgaatgaggaggcctgatgaagttgaaaaataaagcgtcaataaaattcggaatatgtgttgggcttttatgtttaagcattactggtttcacacctttttacagctcaacacatgccgaagcaaaatccatagaagacacaaacatggcaagctgtataacgaataaaaaatttgttcaacttgagaaaaaatttgatgccaggcttggtgtttatgcaattgatacaggttcaaacaagacaatcgcctatcggccgaatgaacgatttgcttacgcatcaacctataaagttctagccgcagctgctgtcctgaagaaaaactcaattgaaaaacttaatgaagtcatccactacagcaaggacgatcttgttacatattctccaatcacagagaaacacctagatacaggcatgagcctaaaagaaatctcggaagcggctatccgttacagcgataataccgctgggaacatcttgttgcaacagcttggcggccctaaaggttttgaaaagtcactgaaacagattggggatcatgtaacgaaagctaaacgattcgagacggatctaaactctgcgattcctggtgatattcgtgacaccagcaccgcaaaagcactggcaaccgatcttaaagccttcactttagataacacgctcacgactgacaaacgcacgatcttaaccgattggatgcgaggcaatgctactggtgacgaactgattcgggcaggcgctccaataggatgggaagtcggcgataaatccggagccggaagttacgggacacgaaacgacattgctatcgtttggccgccaaacagagctcctattgttgtggcaattctgtcaaaccgctttacgaaagatgctaattatgataatgctcttatcgctgaggctgcaaaagtcgtccttaacgatctcaaataaagtgtttggccttttgccacaaaggaaaagacattacttttttaactcctaccgttcattttttgatgaacggttctttcataagacctctagaatcaaatatttaaacaccacaaaattaaacgttattataattaacggcaagttttcattctatggaacaagtaaagtttgacctgacaagaattaagattaagcaccctaaaatccattttcttctccttcaagnnnnnnnnnnnnnnnnnnnnnnnnnnnnnngagacaagtaaacatacaatgcagacaactctcttaagtctcttattctgtgaccaatttgtaatactcattgatattcggactctcttcccaatatttcgtctcgttcgaagacactaacatatcaaaccacttgaattaacataactgaacttgatattggtcactggcagtttcaatgcaatagaacaacatttgttgtctcagaggttatctatatgagaattcaacaatttttttataataattcatatttttgtatcgttgcacttggtggatttgactctttaagtgtatggaaccacacttttattttttcacctcttttgagatcatctgtgttatcaatctcacttaatcctacaattactatgttatttttaaacttgttcataagttgtccttcagaaagatcgtaatcttcttttactggagcttttgtatcggtaatgagaattgccctttcattgtctttaagcacgacatagcctactaggctctgcatctttgtttcttctccgtgttgttcatttttattgcagcctgcaagaaaaataatgagcactatcaagcttactccaattttcggcaacctttctccctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccgctaaaatcgagattttttactttttacgatccattattcactttcgaaacaacttccaatcacagcataatatatgtataaattgtaaatggagttgatgtaattgaagattaagaaaatcttattgagttctgctttatcctttggcatgctaatatccgcggttcccgcattggctgctggcacttcgtctgaggttgcagtaaaaagtgatgaatatgattatgacactatataccgcattagtcctctgccaatggacttccagccaacaatagaatacaacggttatacttatacgcttacacgtcattattttgattactcaatcgggttttacacggctatttatacaaaagttgtttaaatttataaaggagcattttagctcctttttctcttgttttaagcannnnnnnnnnnnnnnnnnnnnnnnnnnnnnnnnnnnnnnnnnnnnnnnnnnnnnnnnnnnnnnnnnnnnnnnnnnnnnnnnnnnnnntttaaatgctggtaataaacaattcactttaaagaagcgccgcccgtaaaatgcggcttttgcacactacgccaattttatatagaaaagccagacctcctccaagaggttccagcttttcttaatgtgctatcgatcttcgttagttcaacgggaactttatcattcggtacaattgcagcctcccaacttctagttagggctgatggcggaatatctgatggctctctacacacatcagacattataagatttcaatgtagccttctgtaccatgaacgcgaattcgttgcccatcttttatcagcttggcagcattttcaacgccaacaactgcaggtaagccatattcacgggctataacagctccatgggtcatcagtccaccaacttcggtgactaggccttttatggatacaaacaatggtgtccagcttggatcggtaaaggaggtatctccatcttctaaatcagcatcttccatgtttaaaatgacacgcgctcgcccctctatcactccggaggaaacaggtagacctacaatcgctccggctgggagattttctcgtttatactcacctgtaacaatttcaccatcagacgtgataacacgtggtggagatagtttttcatataatttgtactcgtcttttcgtgtactgatgattttataatccagtttatgtgtgcgtacgacttcgtgaagttcttcaaaagtgagatagtatatatcttctttttcttgaataacgcccgcttctacgagtcgttcggcttcttccagtaaagcctgcttataaacgaagtatcgattaaccatgccgtattttggatattccctaaacccgctgaaattccggatgatatctatcattcgtttagtttctttggctttttgttcaccatccggtaattgcttcaatcgatctaataactcttgttctttcttcaaagcttcctgtcgcccttgctcaaatttccgatggctggcattaggctcactgttattgatattattaagaatcattgggataagtgtagttggtttttcgctccatcgagttcttgtaatatcaatttctccggtacatcgcattccgtatttgctgagataatcatagatcgcgtctcgggttttgcttccgccatcaaacttagccagttcatccaaaaaattatcatcttttacatgttgtaagtaatcaattacctctggataaggacgaatcacatctgcgacgtctaatagcgcaagacccatttctgaagtaatattatggggtacagattgagaaagcgtatctgctgcgtttttttcacctaaccactcgttcattttttcgttaatccataatgaagcattcatagcagttcgaatcacaacagaactttctgggttaaataaaatcttctttaattcctggatatcttccagaataaaacgaaataaatctgatcctgatttcgtttggatgttttgttttaactcttctatcgatgtttgactgctctcaatcaaatcagacacgattgtcggatcgttttcaacttgagccggcatatctgcattgcctctgctgggatttggtgctgttttatcatttggtatcgactttatgaaatctcgtcgctttattatgttcataagtgcgtcttttaagagctgatcgtgctgccccatgccttttaagaaaacttctctgctgtcaggggatgccagatgatgtgtgacatcaacaaatagccttccaccggctttacgcatgggtgcagcagtcgtcaacagaaaaaaagacaatcctagtggttttatgggatccgtcatcatttgttgatgaccaacagaaatatagacgtgattttcttggtcactcgcttcagggatggggaataaagtagtgattggacgactctgtacaatataaaaagtatcgcgggccaaacaccattcgatatcttgcggctggccgaaatgagcttcgatctgtcttccaatgcgtgccagctgtaaaatttgttcatcagtcagtgtttgagccttttgctaatcagaatcgatctgctgtgtttctgttccgccttcttttcgtccgtagatagccaattttttagttgctattctcttatcgatgatttgcccatcctgtactttataacaatcggcagacaccaatccggaaaccagtgcttcaccaagtccaaaaccggcatcgatggataacacctttcggcttgaggtaatcggatcagcggtaaataaaatccccgaagcctgagggaaaaccatcctttgaacgataacggataaatagacttggctgtggtcaaatccattttgcatacggtaaataaccgcgcgatccgtaaatagggacgcccagcatttactgatatgctgcaagattgcatcgacgccgataatatttaaataggtgtcttgttgaccggcaaaagaagcatgtggtaaatcttcagcagttgcactagaacgcacggcataggcatgttcctcgccgaactgggagagatagtgagccactgctttcacaacatcggaaggaatgtctacttccaaaatgatttgccgaatcttccggctgatgttaccaatttgatctcggtcctcaacttttagcatggtcaattgatccaacaacacttgtaacgtttcgttttgttcgatggctttttgatatcctactgttgtgacacaaaatccttctggtacttgtataccttgaatttttgataattcccctaaatgtaacccttttcctccaacgagcgaaaactgtgttttttcaattttatgtaaaccgagaaccaaagaactcattctacatctccccttcaaaaataaatattgacaagagcttcctagcaggatataataaaattataagatggatatctctaactttttaaccagaaagcgcacgtagtgtgattatatcaccgtgtctgtttttgtgcaatataaaaagaacctgggcaatttcaccaggttcttttcttaatttccatagctagtcgcattaaaaaacttggttcgagctgatacaatcctctaaggaaatcctaaagttgggttcttttcgaactaacctgtcttgttcagtagagtccccatttataaattagactttttgttcttaacagtcccaccgttaactagtataaagttatgaggattctggttaactactgagatatttttattttgagtaaggcttatgtttgataaagaagggttatgtaaaggtgtctgttgtgagcaagcgctgactacaaaaaattgatagcattctcatttaaataccattctattaacctataggaaaagttataaaaccagatggagaataccctacctccagtaattccaaggccgttcacctagtagaaaacaacctttaaccattactaacgattttaataatcattgattataaaacttctcaaggaacgatcatcagcccgttagctacccctgattaaagatgatctgctaccacactgttacgttagaacttccactactttgatatccttctgtcgccatgacttggtaagcccaattactgcccagattcattccatggctcttccatgcgttcacatgattgctgaaagtgattgtagcgttgcttccagttggtctcttcgtctgacgaacactccagtactgcgtaaaagtagtgcgatcgccatcaatggaaggtgcgttataacgtgtagttgtatatatgtcatatgtacccccatcactttttacagtacctttatacgttccagtaggtctataagtaccccatgaatccactacataatattctatgagaggtgatctcgtccaaccatataaagttaaatatccattgccattcggtgcccaaactccggcattatagtttatcgtcctaaatggcgaacctgtagtccaacctttaccaacaacaaaatttccggtattagaccaattaacactgtaattcccgccagacccattaacagcgtttactataccgcccccatcagtccaattttgccagtagtctgtgctagctgcagaggcggttgccgaaaacaagctaatactcattaaagctgccgataatccaactaagaaattctttttaaacttaaacatatgttacctcctataatattttttccgactttgaggtagcactcgtatacatttaaaacattcttaattactaatgccaaagcttttgatcgtccccttcagtataataccacgaattcatgagcaaatattaaaagtatttgtaatttaattacaaatacctagaaacacattataagtggtcttcttccaccatatcctgatccttttttcgtaggatcacaattcttgtttctaattcagatggagtaatatctgcaatgaattcccattgaaccatttctataaaggagatatacagtagagattgtgaaattattgtgctgccgcttgtctaatgaagggaagcaaatctatgaagaatatgaagaatatgaagaactgaagaagaaaacaattaaggttatactaagaaagaactgctcaattagaattattgaccaaaaatttgaggatgatagcttagatcagttttacaaagaagttgcaagatttttatttgaaaggactctgaaaaagaaaaaaagaattgacaatcagggtaactgtgggatgtaaccgagcctccaattcaaaataaaaatctttaaaattcttattttatttaaagagggactgtatatccctctttaaaattaagctttagattgctgctggaagtaataaaaattgtacttttgatcaaacgcttcttcgcttccacaaagaaaaataatgaattcaataaatgcgataatagacgggataccagtccagcaaaacaaaatatatagaataccttgtcctactcttcccaaataaaacttatgtattcccagacccccgaagaaaaatgctaataatgccgctacaattttgttcttcttgcttaccatgacttcctcctagttcattactaccatttttaaagtaatgctttcatattataatgcatttccaccagaaatcgggggaatttttgaacttttgttgagattttttattttattgagaaacgaaagctcaatagatagtattcgggttcgttattcaaaatgtatgaccaaaggttacatcaattaagaaatcgcactaattaaccatggaacagttaggcgagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactataaatatattaaagagggattgctatgactaaattatatacatgtttaatttgcggatataaaggattaagtgaaaacccattaaacaatgatggtgagtatcaaaaaacatttgaaatctgcccttgttgcgattttgaatacggctacagtgaagatcatgacgtaagcttaggttttattgtaactccagattatttaattgacgctgcaattcagttataccgaaaacagtggattgagaatggaatgaaaattgcaaatcctgaagatattccagaagaattaagaaacggtgactgcttaaaatttgaggttttgttaaagcaattgaatagcctaaatctcgatacagaaaactttgaaatcaagggatttaatggttattaggccgcttcaagcccccggtatgggggctttcttattattgtaaagactatcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgacatcatcaagcaattcaacatagatcaattcttacctgaaggtgaatatcacccaaactataatgtcgctccttcacaaaacatcctgacaatcattaacgatggatccaataaccgtctgggcaagcttagatggggccttatccctccttgggctaaagatgaaaagatcggctacaatatgattaatgctcgtgccgacactggccgagaaaccaagctttcgaaagccacttgtcagcaaacgttgtatcatacccgctggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggtctcttatgtatgaaatcaaatgctttcccaaattccttctcttctgttaccgctgagtnnnnnnnnnnnnnnnnnnnnnnnnnnnnnnnnnnnnnnnnnattgaatatatgtagtacttcactcagagcattttgcttattaaggctataataagtgttcgtattaatttttcctgttacgataacgatcaaaaacagagttatctatcccatttcaagccagaaattattctgctttttttaaaaacattcttgattttcacttttatatatgcatccataaagcattcgagcataaccattatatgtaactgaaatgcaggtataagagctattatatagggatttaactaccaatatatagggggtatattaacatccaaatactcaaaaacaagaacaaaagtgcccatagcacctctatttccacaccctccccaaatttacattttcctaatatcgcataaaatcgtcctttttcacatcgtaatcgctatcgtaaaagcctatattatcaacgtttttccttctgaaaattttccctttctcatcaatatctccttaaaacaacccctttcccctactcctgcttatgttttacgatcgtttaccccctattcactaattaaagtatcaaaaatccttatgtttactgtcttttttagctcattataaatttttacgataagcatgttattcgtgtacgatatatgacttaactgtatttggtgacaatttgactgagaaatttaatgcgcttctaacttttttaactgcaatgggtatcattgttgacccaacaactcaaggtatttctgatagttaacaagcaatggattatgattcaccgagataaaacccctacccttctcttaatcgaggagggtatttttttcgttttttgaannnnnnnnnnnnnnnnnnnnnnnnnnnnnnnnnnnnnnnnnnnnnnnnnnnnnnnnnnnnnnnnnnnnnnnnnnntttagaattttgacagaaagaggggtttattatgagtaaacttgcttctgaatatgttgctannnnnnnnnnnnnnnnnnnnnnnnnnnnnnnnnnnnnnnnnnnnnnnnnnnnnnnnnnnnnnnnnnnnnnnnnnnnnnnnnnntttgatgacatggaagaagaccaggaagtattgatgtattactctctacttgaagaaagacataaaatgatgatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacgtaactgagatacttcgcaccgtcttccccgagtaaaacttattaaagagcatcaagcaacatctatatatgtccatcgtgatatttgtgggaagatctattgttttggctcggtgaaaatccaccaccaagatcatctttactgtatcaaatacccaggctgattgttcgaccagctttgttgtgtgtacgtgcccttcttgcgacttcctcgcaaatttccaaaagaacagccttaatctcttctctccttatataatccctcagtaaaatctgactcttaccaaaactaatctgcccttgcatcaaaggagctcctatttctgataaatcgattccatgagcatgataatacaactggtttcccattattccgaacttcttttcaagcagctctaaaggaaatttagctaactgacctacagttgatattcccatccgattcagatttctttccatcctccctcctatcccccacattttagacaacgggtgaaccttccagagtttatttggcacatcttcatatctccaacgtgcaatgccacttttcgttttcttactctccaggtcaagtgcaagcttactaagcaacatattgtcaccaattccaactgtacagatcaggccaaactctctccgcatactactttgaattgctttggccatttcttcaggattttcttttcctgcatctaaaaaagattcatcaattgaatacgtatggacacatttttcaggaacaaatctgtaaaacagctttgtaatctcagttgaaactctgatgaaaagcttcatttgtggatttacaatgtgtattcttggatcttcaggtatctcgaacaatctcgatcctgttttgattccaaaatcttttttaagtgcaggagatgcagctaacactacacttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgttggtaataaaatataaaggtcaataatgatttacgtagtattaataaaggagagattcttttcgacgagggagacggtgatggtaaatgaagaagaggttaattgaatttttgattttagttcctgttttgattatgtcaggtataactttaaccgaagcaaataaaaagtcccctttggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtctcatatttaaattgaatttttatacgcattaactgcttcgtttcgcaacagcatattatctttgttaaccattcctaagttgtaagcttttttgataatatctaatacctgagaatctaacgccgaaagattaccgcctggattaaaccttgatttccaataatctaaagacttatttaggtcaagtgagctttttttgttctcaggtttaactatttcatttttctcaagtttttcacagaattcactaaaaccaatggatctactaggagctgagttatttcccccatatccttctgtagccaagctgcaaaatgctaagaattttggatcataaataagatcgcttgagtttacatttaccaccgataatcacaatcctctcagaactttttataattgtatcaccttttccatttttacacatgttaaatatcgacaatcactcaaatgatttaataactgaatataaaaaagaacctgcattttgcaaattcttttcacgttgttaatatattgaatttttaacgagaaggggatttatgtatagtataatatttcctgttcattaagattgctcactcaagagagtcttgctcatcccctaacgaaagggggtgatgctatgtcaacattccaggtattaatgctaatgcttgcattcgggtcgtttataattgccctgttgacttatataaataaaaaatagacctcccttgagcctcagaacctgaagggataggtctacctagaaaccacatcgagcaagccctttgatggacagctttttgtacatagccggggtgttggtagcacctcggtcttttttattttatgtatttctcattaaagaaatacgctataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcaatacttttgcttaatcgtcccagtcttcatcctcatcccagtcatctttcgcttcctgaatcttattataaaaaaattcaataaagctgtctgcaacagtatcttgataaccaattaccctatcccattcaactacagggcattctccgtctttcattttatttgtatctagacagtaagcaaagtaatcaacatcttcaataaccacaagtccatcagtaaggccatagtgttctttatattcattagttctatttacaactgatgcatgatcaaagttgtaacctaaaactaaaacaccgaataaaccaccagcaccgtatttttctaaaaaccatttataactgttgggaagatcgcattggaggttttcttcaatgcgaccaatgttttcatgacttgcgccttctgtaaatatagcattttgtttattttcattaataaaattctcaaccttcgaataaatcatttaaacacctcaattctcattctcaaattgtttcgctctccacttccaatatctctttctaaagctctcgtattgtgcttttaaaaccttatcatttctaaaactttcaccatcagacttaagctgatgaatgacatcactatattttgtatgtaagctgttagggatttcaagcattgggccaggttcttcttgaatcaagtgatgtaaattaatctgtgtaccatcttctgcataaggggcattcccgtttttcattagctgaagatttgtaacaccgaattctgttttttgattaatatcaatgtccttcatagtatacactctccggcttacatctctaactttccccttcgcctttaccttcccctctatttcatatgcatcatacttttctttatttagccaaggggggcttatcttttggccagtaaacggttttcttgttccatccggtattttcttcgcattagtcaaaagttcattcttaaggctttggctatcaaccacattgtatggcacattatcggctagaggaaagtcgtacttaggattataaggcagcaaatctggaatcttgacgtccttaattttcttccctgcctgacttgctttgtttatgaccttgcccgctgcatctgctttgttaatggctcctgcacctttggttccaaaaacagctacagccactgaaccaacagcatacgttacccatcttgatctagaataggcatctccattcaccatatccttttgatatgactcttctattgctgctgaaatggcatcgtaagttttcactggatgaataactgcatttcccagtgctgatagtgtttctcctggatcggtgatgaaatcccatatgccggttacagtgtctttaccaacatcatataagcctactcctacaccttttacgatatcccaggtgatttctcctgctccttctagctgcttcgcttgttcaatttgcactgcaagctgcacttgagctggctccagattctcgtaccctactttcttagcaatctctaaatattcaacagggtcagagacaccgtcattaagttttttctttaattccttgatttcacggtcctttgcttcttctttcttcacgcttaaataagcttcagaatgcttttcgatatcgccttttttcttatgtatgtcactttctctgtacgctttagcgttatagtgaatcggagtggcgttctttcctttgccagttgattcctgcagctttttaaaatcttgctgaatgaattgttcgttaggctctgtttcagcgtattctgtttttaaatcctcatcaagcttgtttagcttatcgattgttttttcacgtttgtcatctgcagaagaaagtttgtctttgaagtcttctgttgaaaatatttcaaggggaagaatatcattgatgtcgtttaatatgtctttcattgcttttttctgttcagacataatggattttgattttgtataggcgttagccaactcgtgttctaaaaaggattcttctatgtaagcatcagacatcttagcatcttcaagttttgcagacatgctgcttaagaaagcaatcttcatgtcaattaaatcaatccattgatcagtaacaccgacatgatcatgataaaatgctttaatgttgtcagcacccttgcctgaaaactcactgtcatctaggttagctacgttttgaaaagcttttcttagcttcaccatttgcgaccttagttccttatactctttggttcttttatcggcctcaaagagtaatgaatcagcctcaaataccttcatatcattctccttcctagcctactctatgtaaattttaccacagtaatctatttgaataacagaaaaagacagccaaaatgactgtcttatacatcacacactatcttgttctataataattttctgcggtatagtagcgccaatcccaaaaaggttctccattggccaatatataccggtctaaaaatatttcaaagtttacatttaatggattatattctaaaccactttcaaatatatagagataggtgggatcaccttggttcactttatctttatcaatcattaaatggcattcttccaataagtagccaattggaataccattgatatcttcaaacaaatcctcatattttaactcctcttcaatcacttcaaggctaaatagctgaagtccaccacctatattctccccatcagaaagaatctcaaaaattttcgcgccgttatgcagtgtcatgaacttctgataatcttctggaagggtaatctgatgtttagcttcaaggctttgaatgtcattcagggttgctttgtcctgtgaaaatgtaacaaggaactccatgatatcccctttagaacaaaacaattgaatggctccttttttatccaaaagacttttcaagccatttaccgtcttatgaacaaagttagtcacatacatcacccctatatttccttttaacaataacctttcaaattccaaaagatgtgaacagatcgtgataggtgctcttttcagtgaatataatgcaataaattctaaaaagaggtgcctctaaaaattgaattctctaatgaatgatgacatggtaaagatcattagaaatggccttagcgcatcccagcatccaaagcatattcttgttgtaggagctggattgtccgggcttgtatcagcatcattgctgaaaaatgccggtcacagagtaacgattctcgaagcgagcggcagagcgggcggccgtgtctgcactttgagagctccctttagtgatgatttgtattttaacgctggcccgatgcgcataccgaataaccattcgttaaccttagaatatataaaaaaattcaaattgccaacaaatgtatttctcaacagaaccccgatggacatcatttatgcaaatggaatcaaaacacgtctccaagtttttgaacgagctcctggaatattgagatacccagttgcaccaaatgaacaagggaaaacgtctgaagagctgatgctttctttactgcagcctattctaaattttatcaatcaaaatccagcgagaaattggcggattgtcgaagaacaatacaaaaatcattcgttaagctcttttttaaacacgtatttttcatatggcgcgatcgatatgattggtgtacttttggatatggaagcgtatatggggatgtcccttgttgaagtattgcgggaatctatctttttttcatcgcccgctcacttctatgagataactggcggcatggatctgctgcctcacgcgtttcttcctcaattaaaaacaaacattctataccatcaaaaaatgatgaaaatgtctcagggggaaaatagtgttacgatccattgtcagcatcaacaaacggcagaattcacatcattcacagctgatctcgctattgtaaccattcctttttcaacattgcgatttgtaaaagtcgaaccataccattcattctcatactataaacgaagggcaatccgtgagctaaactatatcagtgcaacaaaaatcggcatagagtttaaaagccgattttgggaaaaagccgggcagcgcggcggcaaatctattactgatctaccgattcgtttttcgtattatccaagcagaaatattggagcaaatggacatgccgtcattctggcaagttatacttgggctgatgaggcactgatatgggacagtctttcagaaggagagcgaatccagtatactttactgaatttatctgaaatctatggtgatattgtgtggtctgaatttgtgtctggcacttcttttagctggagccagtacccgtattctgcgggaggttttacagctttcgaaccaggacaagaattagagctgtatccctatattcctgtccctgagggcagagttcatttcgccggagaacacgcctcactcactcatgcgtggatgcaaggcgcgattgaatctggaatacgtgttgcttatgaggtcaatcgcttaccttagatcatgctcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtaatccttgcattccttcgccctccatgctatattcatatagcgatgagctgaattgtgtaagccgatgtacatgcctttacggcacacacgaatgtggcgtgtggtgcatcgcctcaatacgcaaaagacgtttgccttaggcaaacgtctttttttgcgttatccgatttttgtgccgtttgggacaggctgatccggctgcaaaaggacgacgtcgccctggccgggtatgccgccgaggaccaagacttccgatttaaatccggcgattcggcggggcggaaagttcacgactgctatgacttgcttgttgatgagaccttccggcttgtaacgcttcgtgatttgtgcgctcgattgttttatgccgatttcagtcccaaaatctatcacaagcttgattgccggtactcttgcttcaggaaattcttccgcttttacaattgttcccgttctgatatccaatttctcaaagtcttcaataactgccatatcaataactcctttttctcctattgtaaaggagatattcaagatttgtttaaccaaatagccattattttttatctgaatataaggtgtttcgatacaggcggggcggcattcctgtgcttttcgtgaaccatcttgtaaaagaagaaaggttttgaaagcccagcgcctcgctcacgacggtaagagtttcatttctctccatcagcattcgttttgcttcctcaaggcgaaggtcggcaatatagttctgcgggggcttccctgtctgttttttgaaccagcttgaatagtaagctgggtgataatgctcgatttctgccagcttcttaatcgtcagccgctcaaataaatggctgtgaatgtatgcaattgaggcatagctatgggattgaagcttttcttttatgtattgtactagcatatgaagcgagttggctgttccggcctttgcttcctctgtcagcaagtacctgatcgaagaccagaaaggatcgagtgcagcttcaattcccgatcctgcacgatactcatcaattttcattgcatgaagcggaacatccagtacaagacattcatttcttccgatagaacggaaacgatgctcacactccggcggaatatataaaaaatgatctggctttaatttcacctggcgctcttcagtctcaagatcaatactcccttcaagcggaaaaagaaattggctgtatgcgtgcttatgtgaatgataaaggcgtgtgtatgtccgtttttcgcaaatcatctcttgaagcgaatccatcagcaacccccttcctttggtcatcttttaatccggtaatggtgttccgatataggcgaaaatccgatcttttcatataaagaaactgccgccagattgtctttcatcacttgtaaaaacatgcgttccgctccgttgttttttgcccattcagtcaacaccctgatcacttgggttcctgccccttttcctctgtgctcctcagctacaacgatattactaagtccgccataaccatcaatgacagaaaccgtgccaagcgctgtcaggctttctttgtcatacatcttgaaaaaagttttacacggcggcatgcgttcgaaaatgtgtttgtaacctttgtgacgctcgggtgaaaacccttccaattgaataaattcacctatccaaacagatgatggctcttgttcccacttgtatgtaaatcggctgttgtcatttgttcggctcataattgaccggcacaacgctgtcatctggaagcactcgtctaccttttcataacggctgtctgccaaagcgtcatcaagccctttcggtgatgcgttgctaatatgaaaacaaacaggtaagcctaaactttgataaaaaagttcggcctctagttgaaaattcccttcaggcatatccgcagaagtccatacgctatttgcccttttggttacgccaaaattcgctctgagaagccattgccctatgcttttttgaaaataagccggccatgaagctgccgctaaccgttcaatcttgtgaatgtcatccattgcataatgcctctcccctatgtatactcccttgatattatacaatattcagaaatataagacatccatttatttgtttacataatatttttattatttattaataatcctgacaaaaatgtccgaattgaaaatgacaggctttctaaaatgtcctcctcacgttcaaatgcttcttttgcgattaaaacagtaaagccatgcagcaggcttctgagcccccttgtcgcatgaatggcagtcttttcacttgcatagccgttttcaatgagcagcttcgtcacaagacagacaatttggtcagagacgatttccatccgtttgtcctgaaccttaagcagagccgcttcataatatccgggattttcaattgcaaaatcaacatatgcatgtgctaaagaaagcatcgcggaatctccctttcgttcggttacggagtccgccatttgatcaaaaagctttgtcagtcctctaacagcaagttctgctctgatcgcttgcagcccgttgatatggttatacaatgacgggggacgcacattcatttttttagaaagtgccgcaagtgagacaccatttaccccttcctgatcggcaatctccgctgcagcgtctataatcattttttgggtcaaacctattcttggtgacatgctcatcatcctttctttgctttttggattgcctgtctcatccgctctgcgggtgatctcaggaaatttccatgtccgacagcgagacaggaaggcgccttatcggcgagcaattgtgcgcttttgatggcctcctccttattccatgtggcgaaggcgggaaaaggaaacgtccattttatctgacctgatacagcgattcctccgcgcaactgaaacgcatctcctgctattaaagtgccgtttcttgtatcaagaaatgacatgctgcccggtgtatggcccggtgttggaatggcaagcagagaaccaattgtttcaccgcccgtcagcagttggtgaggctttgtttgtatgtgtttcggaatacctccttttataggcgtctgcggctcatcttgccgcaaggatgtgtcaccttggagcaagaatgaatcccgttccgagatcatgacctttgcatgcggaaatgtttgtgccaatgtatccagtgatccgacatggtccccatgtgcatgagtcagtaaaatatgctgaagcggttttccaagctgattcacagcttgaataatccctttatagctgcctggcagtgcggcatcaataagggtgacttcgttttcttcctctactaaatagcaattaaccggaaacaatgctggaaaaaaagtcagctgccaaaccgtttggtactgagtaattctcatctttttaccctcctaacaaaaactaatggcgttagttttattattaactaacaccattagtttttcaagagtttattatttttttatcgctacataaatgttaacttgtgctcgctgtggtactgcggcactttgatcatacatctcaaaatcacctgtaaacgtgcgcagatgccgcttatcccaagtccaaatttccttccacgtttcaagcacaatctcttcaataggaccgattctggaagtgaaaacggcgtaagcggaagccggcaaatcaatgttttcatatggtcccggaagaatgtcgtcgtattcctgaaacgttccgactgaaaacgtataaaacccattcgtctcttgttcataattcgaatataaggcaataatgctcttgtctttttcagcctgtgataaaagagcgctcatatcctgcttccagaattggtcccacagtgccggaatcctcctttcttccgtcatttccagtgcgttgcttgtccgttgtgacagtccggcaaatcgtttccggtctaagtgtgttatatgtgaaaagcccatacgatctcctcctttttttaagattatagacaaagaaacctgacagcagtgtgtcaggtttcatatattttttgcatgtgatgaatggtttcttttactctatcccgtatatgaagaggctgcagaacctcaatatcctttccgaactggagcaaaaaaccgatcagccattgatcttctggaagtgaaatcactgcccggcagatttcatcttcctcacagtgaaggacatcatatccgaaccattcacctatacgctgacgtgctgccggctgaacaagaataaccaattcagttaaacggcccttctggtaccaatttctatcccatggcaaagtgtccagctgaatgtcttttctgataaaggtctgatgtaagatagccagatctttcatccggtttagtttaaaaaaacgaaaatcatttcttaccaggcagtaggcatataaataccagtgccccgccttgcaaaccaatgtataaggttcagtttcacgaagaagtgtttccccgcttgcgcttgtatatgtaaaagatatcgttgacaaccgatcgatggcggcgctgattttctcacgaagcgccttttgatcctcggtatggccccatgccgtcatgtcaataaaccatttttctgtttggtgcttaaatgcttgagcagattgctcaggtataaggtgtttgattttttgataggctgtgctgtgagaaattggttcatacatagatgaaacgctttgcaaagcggaagcaattgcaaacaattcctcctccttcagccactctctttcaagccgatacgtttccatgatgccaattccgcccccggaaccctgtgaggtcacaatcggaataccagccctattgatcgtctcaatatcacggtaaattgttctgacagatacttcaaacagctcagcaagctctgcagcctgcacttgttttttgctgatcaataacacaaccatcgctaacaaacgttccagcttcattctgcgcaccttttcttcttgtattttccaacaaaaacaatcataacattttgataacgcttgggcatatctatcatgcggcggaatacaccttgcatatgctatgaaaacaggggtttccccttcttttttgtgttcagtatttatttcagctactatttctgaccggataagcatacacttctcaacggaggggatttcacatcatgcatcttacacttcagagcgtttatcctgccatgatcatcatcttttttctgtataaaaaaattaaaaggtccatcggataccagccgctgaagccccgctggctgttcacccgtatcattcttttctcgctgtttgcttttggcctttcaatcttcagcgccattcacccttttttatatggatatctcattttgggcattcttggcggatggctccttgtctttttcgctaagaaaaacatctcttttgaaaaacgcagaggaaagatctattttcggactcatatttgggtagaaatgattctcctaaccttattcctgtcaagatttctatatcgagtgacagagctttatcttacctcgcctgatctaaacagccttggatcttacggtcagtcaatcggaacggaccctctgacaattggagtcttttttctgatagccgtttattatatcggtttttcttcttttgtcatcaagctcagcagaaacgaattcgaacagcacggacacaataaagaaaaagacatccttgcccgctagcagcgagttaagcaaggatgtctttttcaatcatgctgcgtatgatggatcatttgctgaagaacatctaaaacatgttcatcctccggagagtaataaatcgatgttccttctctgcgcgatttgacaagccgaagatttttcaaaaatctaagctggtgggacacagtggattgcagtaaattcagcttttctgcaattccgtttactgcatgctcaccctgggacaataaatggagaattctgattcgggtaggatcagaaagcgctttgaatgtttgcgcgactagaaacagcgtctcctcgtccagatcagcagccgattgttccgtttctctaaattcagtcatatgtatcacctttctttattcatagttttatcttataacaaatgcgcttgagtgcaaaccagcctgcttgtattccatttcaatctcatagtttaaatttatgtttcaaatcaggtttttacttggtctgatataccgtcttatgtcataataaaaaaggtcatactgctccaaacattgagggtgaaacacagtgaagaaaaagagaaaaggctgtttcgctgctgcgggttttatgatgatttttgtctttgtcatcgcctcttttttattggtcctgctttttttcaaccgggatttaatcaaaaaacttccgatcgatacgaaaacgattgttttggaacgtttaaccgattacaaacccctggtggaagaagagcttgaaagccaaggactctctaattatacatcactcatattaggcatgatgtatcaggagtcaaaaggaaaaggcaatgatcccatgcagtcctctgaatctctggggttaaaacgcaatgagataacagaccctcaactcagtgttaaacaaggcatcaagcaatttaccctcatgtacaagaccggtaaggaaaaaggcgtggatttggataccattattcaaagctacaacatgggggcaggttacattgattttgtagctgaacatggaggaacgcatactgaggaattggcaaaacaatactccgagcagcaagtcaaaaaaaatcctgatctgtatacttgcgggggaaatgcgaaaaatttccgctatccgtattgctacggtgattatacgtatgcagaaaaagtaaaagaaaaaacaaaaactgttgaagaatctttgcaggttgcaacacttgaaaccatggaatccaaggctcatgaataagagtctatcaatttactgacaaaagcccaaaaatgaatttgggcttttgccatgtttacatgtaaaaaaagccatactgagtatggcttttagtaatacggtgaaatcatcaaatatacaataacgcctgtaaggcttacatacagccatagaggcattgtccatctcgcaatttttttgtggcgctccacctgcatgctgaagcctctgatcagcgtaaacagcgcaagcggcacaataattgcagaaaggcagatatgtgtaattaaaataaagaaataaatcgggcgcataataccttctccgccatagagcgtgttttccgcaatcgagtggtacgtcacatagcaaatcaaaaatagtaatgttgttgtgaatgcggccaaaataaagcgtttgtgagctttgatatttttctgtttaatcataatcagcgcggccaataagaagataaacgtaaagctgttgaatatcgcattcagcattggcaaaatgtgaatattcgcatggctgaactgatctaatttaggcataaaaaacagcactgcgattaaaccgttaatcagaactgtcagcgtaaggacaatccccgtgtaatttttcggtttattttctgtttggttcatttggtgacctctcctaatttgtactggctatccaaatcgtatgcaaattcaaagaagatgtcaacggtttcgattgcttcgtcagaaattagacacacttcaaaggccggaggctattagccccggcctgttaggtttacgcctcttttatcaaatgttcaatgaccttatgttcattttcattcagcaggttcttttgaattttcgaatgaatgggtttattcatatgctgatccaagatatcggccgtttctttatccccggcaataaccattcgttcccatcttttcgcggcagctttttgatcaaggctggcagccagccgcttatacagtctcgattggttctctgttacatgttccctcatccggttctcttcaaatggtggcgctttgtctacagcggaatggctattcttccaagactcattgatcatatcatactcataacgctccaccgcctcaatttttcctaatacggtttcaataattttcacttcatgctgctgagttaaaataaacgccgtacttgggtatgcctggcgcaaaccctttagctgatccaggacagctgtttcttcccagtaaaatcttgtatctacagggacttgaagcttaataagttcccatatgccgctgtcggaaacaaaaaacacgagactgcggggcatgtcttttcccattgcattcaagtattgattcattttagccctgattccatccaggcacttttcctcctctggatcactagctgccaaatactcttttaatcggctgaatcctgactttagggcgatcttccattctcccccctgctgctctggatctctcatgtctgtattgagatacagagagagaattttatccggcggttctaattggacatactgtaatttgttaatcaatgaatcaatcgccattccgattcctcctttttcacaggttagttttctttttcctctcttaaaaacgatcaaacctgactttccgctaatttctagtaataatggaattgttgtttacaatacgcctctcttctaatacaattggtaactgtgtttctaagctgatttttgaaaggagtttgatcttgtttactattaaagaaaaaaatcgtcaagagcttgaagaagaactaaatgatttagaatttcaaatttatcgcatgcaggagaatatgaaggatttatctaaagatgccaaagtgcttggtattgatcaatcgaaacatgatgagtggatgattgtttcctcgattgatgatggccaaacatgcaaaattatgctaactgattgtaaaacggcataccgaggaaaaggctgtttttcacttgtagcgtcttacaaggacgatgccattcatataggggacatcaaaggccctccgaatcacgggtttggctccatttgcatgaaatatttaaaagatattgcaagagaccacaatataccgaaagtcaccggagacatcgccaaacgggattggaatcatgtagaccggctgattcacttttatgaaaaacatcaattcaaagtatgtatcgatcaggatacccaatccggcagcattaagtgggttgatttgtaaaaaagtctggaagaaagagccaagatatgctgtaatggtataaaaccattgatggagggttctatgtacgcctcaaaactgaaaaagggagacgaaatccggatcgtgtctcccgcgaccagcatgtctatattatcaaatgaagcaaaaatccaagcaaaaacggcgttagaacgcttaggttatcgggtaaccatcgctgaacacgcaaataaatgtaacgaatttgattcatcctctatcgagtcaagagtccatgatctgcacgctgccttttttgatccaggcgtcaaagcgattttaacgacactcggagggtttaattcaaatcagctgctgcgttatcttgattacgagaaaatcaaacgacatccaaaaattctgtgcggctattccgatataaccgctctttgcaacgctatttatcaaaaaacgggtcttgttacgtattcaggtccccacttctcaacatttgcaatgaaaaaagggcttgattatacacaagagtattttctttcttgctgcgcttcggacgacccgtttgaaattcttccttcaagtgagtggagcgatgatcgctggtttttggatcaagaaaacaggcgtttttatcctaataacggccctgtagtaatccaagaaggttatgcggaaggcactttaattggcggaaacttatgcacgcttaatttgctgcagggtacggagtattttcctgaaacagaacatactattttattgattgaagatgattatatgtcagacatccacatgtttgaccgcgatctgcaatcactcatccacctccccgctttttcacatgtaaaggcgattttgatcggcagatttcagaaagcatcaaacgtatcaatggatcttgtaaaagccatgatcgaaacaaaaaaagaattatccggcatcccgatcatcgcaaatataaatgccggacatacctcgccaattgccacgttccctataggaggaacatgcaggattgaagctatttcgggtacatcacgaatatggattgataaacattaatcagcttgtaaatttttttacaagcttttttagcgcaatcggttatgcatgccgcacgagacatgacaaatgtcatataggaggcatgatgtgtgctactacaaaagacttctctcattagcgtatactgaaccgagacacacaatgagaggatacttactatgactgaacaaaccattgcacataaacaaaaacagctgacaaagcaagtcgctgcatttgctcagcctgaaacaaaaaacagcctgattcagcttttaaacacgtttatcccattcttcggcctatggtttcttgcttatctcagcctcgatgtctcctatcttcttacgttagcattaacggtgattgccgcaggttttctgacaagaatttttatcatcttccatgactgctgccatcaatcttttttcaaacaaaaacgctataaccacattctcggttttctgacaggtgtcctgactttattcccgtatcttcaatggcagcacagccattcgattcatcatgcgactagcagcaatctggataaacgcggaacaggagacatctggatgttaacagtaaacgaatataaagctgcatccagacgaacaaagcttgcatacagactttatagaaacccgtttatcatgtttattctcggaccgatttatgtttttctgatcacgaaccgttttaacaaaaaaggcgcaagacgcaaggaacgtgtaaacacataccttacgaatctggcaattgtcgcgttggctgccgcttgctgtctgatctttggctggcaatcgtttttactggtgcaaggcccgatatttctgatttcaggttcaatcggtgtttggctgttttatgtgcagcatacctttgaagattcttattttgaagcggatgaaaactggagctacgttcaggctgctgttgaaggcagttcattttataaactcccgaaactgcttcaatggctaacaggcaatattggttaccaccacgttcatcatttgagtccaaaggtgcctaactataagcttgaagttgctcatgaacatcacgaaccattaaaaaacgtaccgacaatcaccttaaaaacaagcctgcaatcactcgcgttccgtctttgggatgaagataacaaacagtttgtgtcatttcgggctataaaacatatacctgtaagccttccgcctgattcaccagaaaaacagaagctgcggaagaatgcctgatgataaaggaggtcttctaatatactagaaggcttcctttttattgttggagggtgcattctggctttcacaatgataaagttacaagtaagatgaaaagctgaaaatgaggtaagatcatgattaaaaatcattttacatttcaaaaactaaacgggattacgccctatatatggacgatatttttcatcctccccttctactttatatggaaatcatcatctacatttgttattattatcggcatcattttgacgcttttatttttttcggtatatcgatttgcttttgtctcaaaaggctggaccatttatttgtggggatttttattaattggcatttcaaccgcctccattaccctgttcagttatatttattttgctttttttatcgcgtattttattggaaacattaaggaacgcgtcccttttcatattttatattatgtccatttaataagcgcagccgtcgcagccaatttcagtctcgtattaaaaaaggaattctttctgacacaaattccttttgtcgtcattaccctcatcagcgcaattttattgccctttagtataagaagccgcaaggagcgcgaacggcttgaagaaaagctcgaggatgcaaatgaacggattgcagaactggtaaaattagaagaacgtcagcgaattgcccgcgatctccatgatacgcttgggcaaaagctttctcttattggtttaaaaagcgacttagcaagaaaattgatatacaaagatcccgaacaagcagctcgtgaactgaaaagtgttcagcaaacagcgcgaacttctttaaatgaagtaagaaaaatcgtttcctctatgaagggcatccggctcaaggatgaattgatcaacatcaaacaaattctcgaagcagctgacattatgtttatctatgaagaagagaaatggcccgaaaatatctcattgctgaatgaaaacattttgagcatgtgcttaaaggaagctgtcacaaatgtcgtcaaacacagccaggctaaaacttgccgagttgacattcagcagctctggaaggaagttgtgattacagtgtctgacgatggaacattcaaaggagaagaaaattccttttcaaaaggacatggcttactcgggatgagagaacggcttgagtttgcaaacggaagccttcacatcgataccgaaaacggaaccaagcttaccatggcaattcctaataattcaaaataaacataaaggatggcttatatgattagtatatttattgcagaagatcagcaaatgctgctgggcgctttaggatcacttctaaacctcgaagacgatatggaagtcgtaggcaaaggtacaaccggccaagatgctgttgattttgtcaaaaaacgccagcctgatgtatgtattatggacattgaaatgcccggaaaaacagggcttgaagctgctgaggagctaaaagatacaggctgcaaaattatcatcttaaccaccttcgccagacccggttactttcagagagctattaaagctggtgttaaaggctatttgttaaaagacagtccgagtgaagagctggccaacgccatccgtagcgtcatgaacggaaaacgaatctatgcacctgagctgatggaggacttatacagcgaagctaaccctcttacagatagagaaaaagaagtgcttgaacttgtggctgacggtaaaaacacaaaagaaatcgctcaggaactcagcatcaaaagcgggacggtgcggaattatatctcaatgattctagaaaagcttgaagtgaaaaatcgaattgaagccattacccggtcaaaggaaaaaggctggtttaaataaaaaaggatcttggcatctgccaggatcctttttttaacctgaaattcccgtttgagaacctcgccgcaaccagaagaattaaactgatccatatcctcgctcctatgcccgctgaacgattgcttggttaacagcccaataaaagactggattgaatgatatccctgttaaaatggtcggccattgcacatcagcagaatttctgatattgattatattgtattttcagtatgacaaagttgtgccacttcgctcccgaagctgccatgcccaactgcaagagcctaataacacaataaagaaccgtctgaaatcaatccgaatccgtcaatggcatctgctacatccaactgcttattatctgccaaaaaagatacaacaccagctcgtttcgctgatcaaagatagtaacaaccagctataaatgtcatgatgccgaatgtctctgtaatgtggaatcaatcttttaacccgagagcccctgaatcgcacataaagagaaaaacgggaccactttcttttatcagcatatgatataaacagctctaagcagaacgaaaaaaagacacaagccaaaagctcatgtcttttaccacaatctatattattagtttaagattttaacatttacagttttgacgccccaattagatgcatcacttttacttggtacaaatacgtcgattttatttcctttaatagcgccgccagtgtctgctgctgttgcttccccgtagccttcaacatagactttagaacctagcggaattacattaggatcaaccgcaataactttagcgttcgggttcttatttaagtcaatgcctgtagctgtaacgccggaaatgccgccgtcgttagcagtgtaagcagtagcagtaactgttagttcttttgaagcttcttgattatttgtatttgattgaacagccttctcctctgtgttaacagaagtttctgcctcagcctttgtttcttgtttaggttgctgttgtacagcttcttgtttaggttgctctttttgcacagcctcttgttttggcgcagcttgaggtgcgtttgtttgcgcattctcagtagctgtgtttgctgctgttgcctgaccttttactgaaagagttgatccagcatagatcatgtcagagcttaagttattccaaactttcaggttgttgactgtcgtgccgaatttttgagcaatcttagaaagcgtatctcccgctttaattgtatattgcccagtcgtggttgtttcttctgaagaaatggtcagtttttctcctgcaatgattttatcagaagttaacttgttccattcttttaagtcctttaggttcactccatttttctgagagattccccagagcgtatcacccttttgcaccgtaatttcttttgcagaagcgtgagctccgaatgcagttgttgaaagtgcagcaactgccacaaaggacataatcgtcttcttcataagtaaatcctcccttgttagctttttattggcggctaacaggtgatatcgtaacacacgtaaatgtcaaatcaataacaaaaagatatgatttagattacagttcctttacatgaaggatttctctctgatggaaagacttgctgaacccttgatataataggcttcgcaggtctttttattttgaggcaaaacagagaaaataaaatgtgttttttatagaaaaaaagattgtttttctgtttttttagtctgtcatccttgcataagcttgtatttcttgtaaaaaaagccggccgtattttgctcttttttgttctccgactccttttatagacaaaagttcatcatcatttacgggctgttttcctgacatttcttttaacgtttggtcagagaaaacaacaaatggcggaacaccctgatcagccgcaatttctttccgaaccatgcgcaatcgttcaaatagctcgtcattttcagtaatcgctgccgcttttaacgcttcttttctcgctactgataattctcctttcagcacattccttcctttactactgacaaaaagagtcggaaacgttccgtctgacatcctgatgaagtcgtcagaaataagaaattcgataaaatcgctgatttcgccaacggattggtgttttaatatcccgtatgttgagaggtctgaaaagccgttttcaagaacttttttatttttggagccggcaagcacctgggcaaccatcgtcttgccaaaccgttctttcatgcgaatgatacaagataagaccatttgcgcctcccgcgtcacgtcatgggccgctcttgtatcggtacagtttccgcactgtccgcacgcattaggctccttttctccgaaatacataaggataaaacgctgcagacaatcttccgtatgacagtagtcgaccatttgtctcagcttttttaaatcctgcttttgtttctcttcatgttctgattgctcaattaagaagcgctggaccataatatcctgcggtgaaaacaggagaacacattcactggcaaggccgtcccgtccagctcgtcctgcctcttgataatagctttccatatctttcggaatttgtgcatgcagaacaaatctaatatttgatttatcaatacccattccaaaagcagaggttgccaccatcacttgaagctcatcattaagaaacctttcctgctgctcttttctctcatcatcagccaaacctccgtgataccggcctgccctgacctgatttcgtttcaatctctcatatatccgatcagcttcttttctggtcgctgtatagacaattcctgcttcatgcctgttgttttgcacatattcgtctataaaccgatctttattttctccttttactactttaaaggttaaattctctcgggaaaatccggtatataccgtgttttctttttgaatatgcagctgtttgcaaatatcatcatgaacctcgggtgtggctgttgctgttaacgccatgatgacaggcttgtcgtgtaattcacggaacaagatttcaatattcctgtagcttggcctgaaatcatggccccattgagaaatacagtgcgcctcgtctattgcgaccaaaggaacatctatgccctgcaaaatccggataaactctgtggacgttagtcgctctggtgtaatgtaaaaaagcttataagccccttctttgagtccgttcagcctctcataaatttcctgattggattgtgtgctgttaatgtaggcggcgttaatccccgcttcttctaacgcatcaacttgatccttcatcaaggaaatcaacggtgatatgacgatcgtcgtcccttcaaacattaatgctggaatttgatagcaaatcgatttgccgcctcccgtcggcataatgcaggccgtattttgcctcgcttccgtcaccaagcggatcgcttcatcttggccgctccgaaacttctcataaccaaaataatgagccagaagggattgggctctatgtaacataacgtgtaaacctcgcttttccttgaatttctcccatcatatcataaaaaagcggccttcatttcattcacacaaaaatggaatattcactataccaaacctttttagataaaataaaaagccatttccgaaaaggaaatggctttcgctacgtcttgccgtatgcaagtaagaaagttttaaaccaccactcctcaaagtgggtgtttgcagaaacgttcctgtcgtcctctgcaatggaggcatgacattccggcttcgatataaaactccctattacagcttaaaggttaaaacttaattaacaatacgcacaaagtagcttctttaatatagtacaccatcaggcgcttttaatcaagaggtctgaacaattgtttagaaaaactttttccagtgaataagactgctttttctccaaaatacctgacaattcgacaaacaaaaaatatattacaataaaaaaaaacagcctttttcgctaaaagcgaatgattattttcttctatattaatgtgtatatacaaaaagactcctatttgtaacgataggagtcttggctttattagaattttgcagcaagatcttttgcttcttgtaaacctttttcaacgatttcttgcgcttgatcaggtgctgcgttatgtccttcgatgacaactgtgtgcaagtcttgaacaccccagaaaccaagaactgttttcatgaagtttaatgacatttcaagtgcagccattggtccttctgagtagacaccgccgcgagcgttaagaagcgcaacttttttgccgcccattaaaccgactggtccttcttgtgtgtatttgaatgtaacgcctgcgcgagacagataatcaacataagtatgaagcactgctggcactgtgaagttccaaagcgggaatgcgaaaacaactttgtcagcttttacaaactggttcagatatttgtcagcaattgctgcttgttttttctcatcttctgtcatttccattccttgacctgctttaaatgttccgttaatcatatctctgccaaggtaaggaaggttttccttatgaagatctaattcaaccacttcatcattagggttgttttctttataagcagctaagaaagcttcgtaaagtttagttgaaacgccttcttcagctgtacggtcgcttgattttacaaataaaactgtagacatctgtattcctcccggtaaactttttatatttacttacaaatagtatgttactttcttttttacgcaaagtcaatcactttattttgaatatgagattttttttcaaaaaaaaagcaagtacatctaatatcggtgtacttgcttggcatttttacttcgaatcttgttcacgatccaagatttcatacgtctgcgagcttttttgatcaattgtttctttgttggataagtcttttacctgttcatgaaactctctttcataagaaggagcatctgtctccagatcatcctccacatcagcttgggcctcaactgtcattcttgcataaggaacagcttcaagtctttcgtaaggaatctcttggccggttttttcacacacgccgtaagttccgtctttcatcttttgtaatgcacggttgacctcctctaacagctcccggtcaatctctctcactgtttggtctgtcatccgatctgtgacgagcgtcccgtggtctgccatatggttgtcaaccccattggaaagctcccccacttcttccgtcattgattctgtttcctttttctcgcccgacaattctttttgcatatcgagcaatttatgatagagatgctgtgtttgttcttttgtcagtgccatgtatatcctctcctttctatcctgtttcccgttttgccttctgtcaaacatgggaacatcgatggaaagatgagctactgcctttttgaacggatcgtgaccgctggcgtcgatggtgcttcgggttttcgttggcactttttgtccttctcttctggcggtatataataggttgcgcctatatttaatctgccgctcagttcatcaatggtcagctcgccgaattcaagatgatagtcaattttttcgacattcagcgtttcaatatgtatataggtttcttcagactcctgtttgctgctttgtttttgtttctcaatcactgagagtctttcttcacattcacgcagtttgtcaagttctggtttcaagcaatgcctgatcagcgaccggaacatttttttcatgacatcacgaccctttgcatactcctctttcgtctacatatataatgaggtatatcccatagaaaggagaggttttcatgcttccgactaacatcaatatttctcatttcaagactaactcgataggcaccggctcatcccttacctttggttctgcggagttaaggaacaggcgctctgctatcaaaagaaataacggttttggggaacaaaatgcagatgttattgtcatggtcattccgattgaatcaattgatgactgtgatggggcagatgcactcggtatgaaaatcaatcatcaataacaatggttttcgcttgaccttcgtctttttgaatagtgatgtataggattccgtctttaaaaatggcattcatctttccatgaagatgatcggaaagcggaattttcttttcaaaacttccgtatctcccttctttttggcgaaagtcctgttcattaaaataggaaaagcgctgccccttcaccactaaataatctccgtacgataatatgtgaacgtcttgtttacggtagcctggaagataaattaaaaattgtacttccgtaacggtatctacaatatccatgctcggaaatgaagcatctcctttccctcgctgatcttgctgcgcaaacggaaacggagattggccatttgtcataaaaggggttttttggtcttcatcaaatacctgtttccaaaagtcaccgccgtacatctgctgtgcgaattccatccactgcttcatcttttcgaaatccatttgaagccccctgtcttaacatactttataaccgccagcatacaactatagaaaggaggtttgcctgtggttcaaccaactccgtatatcaatattaatattttcatgctgaaaattaattcctttgaaaatgcttcagcggttaacgtaggacaaaatttattggcagaatggcaaaattcagataaaaaaaatcaaggctacggacagaattttggagatgcgagcggatttatgggcacgagaagccatgtggatgacagagaccaaattgattctccggcctcttttgaaagtgaagcggttaactcctcaatcaaaaggaagtgatgagatgttcttttctccctccgtcgtgaatgtcggcggatttaaaatcaatacaatggaccgtggttcctctttaacactcggtccgtatcagcaggtcgattactttttatcagctaaaataaatcaagggtttggagaagaaaatggcgactttactcctcttgtcgtaccgatttcaaatgtattagatgcagatcttgttgattcgaactcagcgaaaaacagtgtggtgtaataagaacagggcgcacatgccctgttcttgtttttatatataaaaaaagcctaaccattttttgaacggctggctcatcaaatattcagctgcacaaatgctttgtcagcaccgcctgaacctcgcttaaatcggtgtctttcgcaaattctaattcgaacgttttgcttcttgtcatcaataaaagcccagtgtccggatcaaacattcccgcttcttgaatggcaaagctttcaattgttttatatggaagaaatacacgaaccttctttttagaaaacattttattgtcaaagaaaatgatccgcttatttgtaaagcaaatttggtccactcggagcttataaatcgattctattctttccccttcaacgagcaaagcctcaagcttctttgcgtccgttgatctgctaacagaaaaaatacccaatgaagaacccctctttctgcatttatctatttgttttatcattcactacataaaaataagtcctttatccctatataagaatacgacatagaagacatttaaaccattacgaacagattacatttttcaaatttttgatttgttttttggcttttaagctgttgtcatcaagtaatacgcacatatagagaaaaaagtttcaatattcagcaatgtttttataaaaaagtggtttttaatgatttttttaattttgttttatatttcctgttttaaccacaaaaaaaccgcagctgagctgcggttttatgtatcgactgcttttaacaaaatctgtttgatgcttcaaggaagcattacatctcttcgaagtattctttataatagccgccgactttattcgtattgtcgaccacaaagagaaactcctctgtttcattttttacttcatattcttttcccggcgttaaaacgcggtttacgatatatttttttgcgtttgtctgcacacactttacttttttaattgtttctttttcaagccaatttttatgaatcatgatgaaatctccttttcttatctataagcatattgtagcttttttcttttgtaaattgcaatatcggttattcattgattttgccttgattcctattatagaatgtttgtatacgcttacgtttgaagcaactatcacagcttatttctgctattcaatccaggaatcaatgtgctatcaccaagaatctcagaacagaccataaaaaatgactggaggtttgttacggatgagttctttaacgatgcaagtgacgaaaaggctggagacatttttacagggaacaaagaagctttatattgacggaaagtttgttccgagtgcctcaggggcaacctttgacactccaaacccggctaccggcgaaaccttgatgacgctgtatgaagcccaggctgcggatgtggacaaagcggttaaagctgcccggaaagcctttgaccaaggtgaatggagaacaatgtctccagcttcgagaagcagactgatgtataagctggcagacttaatggaagagcataaaactgagcttgctcagcttgaaacacttgataatgggaaaccgatcaatgaaacgactaatggagatattccgctggctattgagcatatgcgctattacgccggctggtgtacaaaaataacaggacagacgattccggtttccggcgcttattttaattatacgcgtcatgagcctgtcggtgtcgtcggccagatcattccatggaatttcccgctcctgatggcgatgtggaaaatgggcgcggcacttgcaacaggctgtacaatcgtcctcaaaccggctgaacaaacaccgctttcagctctttatttggcagaattaattgaccaagccggtttccctgccggtgtaatcaacatcatcccaggattcggtgaagatgcgggagaagcgctgacgaaccacgaagcggttgataaaattgcctttaccggttccactgaaatcggaaagaaaatcatgtccaccgcagcgaaaagcattaagcgtgtgacattggagctgggcggaaaatcgcctaatattcttctgccggatgcgaatttgaaaaaagccatcccgggcgctttaaacggtgtgatgtttaaccagggccaagtctgctgtgcgggctcacgtgtcttcattcataaagaccaatatgatgaagttgttgatgaaatggcgtcctatgctgagtcactccgccaaggagcgggacttcataaagatactcaaatcgggcctctcgtaagcaaggaacagcatgagcgcgttctttcctatattcaaaaaggaaaagatgaaggagcaaaagcagtgaccggcggaagctgtccttttgaagcaggatattttgtcgcaccgactgtgtttgcgaatgttgaagacgaaatgaccatcgcaaaagaagaaattttcggacccgtgctgactgcaattccgtacgaaacagtcgatgaagttattgaacgggcaaaccattcagaatatgggcttgcagccggactatggacagagaacgtcaagcaggctcactatatcgcggaccgacttcaagccggaaccgtttgggtcaactgctataatgtgtttgacgcggcgtctccatttggcggttataaacagtcaggactcggacgagaaatgggatcatatgccttggataattacacagaagtcaaaagtgtatgggtaaaccttgaagactaacatgtatgtttaaaaaactgctgcctgccagcagtttttttctttctgtaatggcagtaaaagacgctgaatatatatgcttctgaaggagttgagcgtgatgggcacacttcaggagaaagtgaggcgttttcaaaagaaaaccattaccgagttaagagacaggcaaaatgctgatggttcatggacattttgctttgaaggaccaatcatgacaaattccttttttattttgctccttacctcactagatgaaggcgaaaatgaaaaagaactgatatcatcccttgcagccggcattcatgcaaaacagcagccagacggcacatttatcaactatcccgacgaaacgtgcggaactctaacggctaccgtccaaggatatgtcgggatgctggcttcaggatgttttcacagatctgagccgcacatgaagaaagctgaacaatttatcatctcatatggcggtttgagacatgttcattttatgacaaaatggatgcttgccgcgaacgggctttacccttggcctgctttgtatttaccattatcactcatggcgctccccccaacattgccgattcatttctatcagttcagctcatatgcccgtattcattttgctcctatggctgtaacactcaatcagcgatttgtccttattaaccgcaatatttcatctcttcgccatctcgatccgcacatgacaaaaaatcctttcacttggcttcggtctgatgctttcgatgaaagagatctcacgtctattttgtcacattggaaacgcgtttttcatgcaccatttgcttttcagcagctgggcctacagacagctaaaacgtatatgctggaccggattgaaaaagatggaacattatacagctatgcgagcgcaaccatatatatggtttacagccttctgtcacttggtgtgtcacgctattctcctattatcaggagagcgattaccggcattaaatcactggtgactaaatgcaacgggattccttatctggaaaactctacttcaactgtttgggatacagctctaatcagctatgcccttcaaaaaaatggtgtgaccgaaacggatggctctgttacaaaagcagccgactttttgctagaacgccagcataccaaaacagcagattggtctgtcaaaaatccaaattcagttcctggcggctgggggttttcaaacattaatacaaataaccctgactgtgacgacactgcagccgttttaaaggcgattccccgcaatcattctcctgcagcatgggagcggggggtatcttggcttttatcgatgcaaaacaatgacggcggattttctgcttttgaaaaaaacgtgaaccatccactgatccgccttctgccgcttgaatccgccgaggacgctgcagttgacccttcaaccgccgacctcaccggacgagtactgcactttttaggcgagaaagttggcttcacagaaaaacaacaacatattcaacgcgcagtgaagtggctattcgaacatcaggaacaaaatgggtcttggtacggcagatggggtgtttgctacatttacggcacttgggctgctcttactggtatgcatgcatgcggggttgaccgaaagcatcccggtatacaaaaggctctgcgttggctcaaatccatacaaaatgatgacggaagctggggagaatcctgcaaaagcgccgaaatcaaaacatatgtaccgcttcatagaggaaccattgtacaaacggcctgggctttagacgctttgctcacatatgaaaattccgaacatccgtctgttgtgaaaggcatgcaataccttaccgacagcagttcgcatagcgccgatagcctcgcgtatccagcagggatcggattgccgaagcaattttatattcgctatcacagttatccatatgtattctctttgctggctgtcgggaaatatttagattctattgaaaaggagacagcaaatgaaacgtgaatcttatcaaacggagatgttcaattggtgtgaagccctgaaagatcagattcaaaagcgaggacagcttgaccagtttgaagatcaaatcgacaagatgattgaggctctggaagatgaccaaacaacagaagaagattggtataaacaggccgctgccctttaccgggatattacagaatcagatgatacaagtgaaagacgcgcatatgtccctatagggaaacacgtgctgccaaagcttccttacaaatactccgccttagaaccttatatttcacgcgatattatggtccttcatcatacaaaacatcatcaaagctatgtcgatggcctgaacaaagcagaatcagagcttaaaaaagcgagagcaacaaagaattatgacttaatcactcattgggaaagagagcttgcgttccatggagcaggccattatttgcacagtattttttggttttctatgcatccaaacggaaaacggcgtcctacaggggcattgttccaaatgatagacctttcatttggaagctattccgcttttaaagaacattttacccaggccgctaaaaaagtggaaggcgtcggctgggccattctggtctgggcacctcgatcaggacggctggagattttaacggcagaaaaacaccagcaatgggatgtgatcccccttttaccgcttgacgtatgggagcatgcctactatttgcaatacaaaaatgaccgggccagctatgtcgatcactggtggaatgtcgtggattggcgcgaggctgaaaaacgttttgagcaggcaaaagaagtcgtttggaagctctattaaaaaaagccccctttcctcgggggcttcgtgtgttaaaaaatccctaccacatgcaaaaacacgatgataatggcaacaggagataaatatcgaataagcagcagccaaaccgcaaaccactttcgtttgagattggaaccgcttttcagctcgtcaaacaaatcctgtttcggtatttttagcgggacaaaaatcgaaatcagtaacgcacctaacggcattaaaatattgctcacaagatagtcggccgcatcaaaaatagacagatgaaatatagagacgtcacttaagacaccgtatgacaatgcagacggcacaccgacaataaaaatagcaattccgcctaaccaagcgaatcgttttctcttattgacatcgcctttcgacagtactgcgaccaaaatttccagcattgaaaaagcagatgtcaatgcagcaaataaaaatagaagtaaaaatgctaataaaaagataattccgaacggcatttgattaaacacagtcggcagaacgttaaataacagaaccgggccttggtctggcttgaggccgaatgaaaatacagctggaaaaatcgcaattccggccattacagcaacaagcatgttcataacagttacagatacagcggactgtaccagattttcctgtttctctaaataagcgctatacgttaccatgacagatacaccgacacttaataagaaaaaggattgtcccattgcatataaaatggtattggcatcaattgcagttaaatcaggcatcaggaaaaatttgataccttccatcgcgccatcaagtgtaaccgaacgcaccattaaaatgatgaataatagaaaaagcgccggcattaatacttggcttgctttttcaattccgctgcttaccccttttgcaacaactaaaattgttaccaccataaagagcagctggcctcctacagccaaataaggatttgaaatggtacttgcaaatatcgtatcaaaaccagatgtttgcgataaaccgccagtgaagccttttataatataaattaaaatccatccgcctaccacactgtagaaagatagaagaataaagcacgtcaccatgcctaaataaccgatccaatgccacttcgttcctggagcaagtgctttataggactgaacggcatctttctgtgttcttctgcctatgatgaattcacctaacaataaaggcagtccgattaaaaccgtaaataaaataaaaataagtaaaaatgcgcctcctccgctggttccggcaacatatgggaatttccatatcgcaccaagcccgatagctgatcctgccgcggctaaaataaagccgagcttcgaagaccattgatttgcttccttcaccgtatcactcctatttgatctaaccattataaaggttcattgtaagaatatcttcctatatagtcaagaacattttgattagtttacatcatatatctatagacatctaccaaaaactaatattgaattattcagaaaattatttataataagagaatgttatgaaatttgcaagaatttctgctgaagttcttgataagtgtgttaggagtgtttttatggacatcattagaaaaataagtcattttgcaggacaaacctttggcatatgggtcattgtttttgcagtgctgggattttctttcccatctttatttacgtggatcagttcttatattacgatttttcttggcattatcatgtttgggatgggccttacactgcaagccgatgatttcaaagagctagtcagaaagccttggcaagttattattggagtaatagctcagtatacgatcatgccgctcgttgctttcggcctcgcatttgggcttcatcttccagctgaaatcgcagttggtgttattcttgtcggctgctgtcccgggggaactgcatctaatgttatgacattcttagcaaaaggaaatactgccctttctgttgcggttacgacaatttctaccttattggcacctgttgtaacaccgttgttgattatgctgtttgccaaagaatggcttcctgtctcgccggggtctttgtttatctcaatcttacaggcggttttatttccgatcattgcaggtctgattgtcaaaatgtttttcagaaaacaagtggcaaaagccgtacatgcccttccgcttgtttctgtcattggcatcgttgcgattgtctcagctgtcgtcagcggcaatcgggaaaatctgcttcaatcggggttgctcattttttcagttgttatcctgcataatggtatcggttatttacttgggtttctttgtgcaaagcttttaaaaatggattacccgtctcaaaaagcgattgcaatcgaagtcggcatgcaaaactccgggcttggggctgcacttgccacggctcatttctcaccgctatctgccgtaccaagcgcaatattcagtgtgtggcataacctttcaggttctatgcttgcaacatattggtccaaaaaagtgaaaaagatacaagctggatccgaaagcagcaatctatcactttaaatatgcatcaaaaaaggtacatcactttatcgtgatgtacccttttttattatccttctaataaaagctgttcaggatcttccagtaaatttttgattgtcacgaggaaaccaaccgcttctttaccgtctacaattcggtgatcataagataaagcgatatacatcatcggacggttttcgaaacgctcttcatcaatggctacagggcgcagctgaatcttatgcatgcccagtataccgacttgcgggctgtttaaaattggagttgacatcaatgaaccgaaagtccctccgtttgtaatcgtgaaagagcctccctgaagctcgctaagggttaatttattgtttcttgcttttttcgcaagctcgccgatctctttttcgattcctgcaaatgtcaggcgatccgcatcccgcacaaccggaacgacaaggccttcatcagcagcaacagcgattccgatatcgtagaattttttaacgatcaactcatcgccttgaatttctgcattcaacagcggatattttttcaatgcagccacgaccgctttcgtgaagaaagacataaagccgagcttcacttcattttgctcaaagaattgatctttgcggcgttttctgagattcatgacagccgtcatgtccacttcattaaatgtggtcagcatcgctgatgtttgctgtacctctacaaggcgttttgcaatcgtttgtctgcggcgtgacattttttgcacttcaacaggtttttcaaagctttgctgtgctttttgagcctgaggctgctgcttttgctgaggagccggttttgatgccggtttttcgtacgcttcgacatcctgcttgcgcactcttccaagcggatctccagttggaacttgagacaggtcaattcctttttctctcgccagcttacgggccgacggagaagcgatcgttcttgattttgcttcagattgtgcttcctcgctcacctcttgtgcagctggttcagcctgtttctcttcttttacgctttccttgctttctgctttctctgtaggagcaggggcagaactttcacccgcgccttctgaaatcgtaccgataatttctccgacctggacggtatcacccgaatctttcaatacctcttgaagtacacccgattcttctgctgtcaattcaacattcactttatccgtttctagttcaagcagatattcaccctgttctacatagtcaccaggctgctttaaccattgggctattgttccttctgagattgattctgctaattcaggtaccttaatttccgccatttttcatttcccccttagtttttgcgagtcaagctatcagatacaatacgttcctgttcttttttatgaactgtcggatctccctctgcagggctggatcgtcttcttcgtccaatatattgaacgcttactccctctggtgcaatctctgtcaaatacgggctgatataaccccaagcccccatgttctgcggctcttcctgcacccaaacgatttctttcaggttcggaagttttgcaaataattctttgactccttttgccgggaatggatacagctgttcgattctcgcaatgtgaagccactctttaccgtcttctaacttattaaaatgatcgctaatgtctatagacactttaccgctggataatacaagtctggttactttttcatagtcatgagaaagtcccgactgttcataaacaggctggaagcggctttcgctgagctcctgcacttccgacaccgtatttgggttgcgaagaaggctcttcggcgtcataatgacgagcggtctgatttcttcacgaagcagcattttagcctgtcttcttaaaatatggaaatactgtgccgcgcttgtcaggttggcaaccgtccagttgttttccgctgcaagctgcaggaatcgctcgattcttccgcttgagtgctcaggcccctgtccctcgtaaccgtgcgggagcaacatgactaatccggatttttggccccatttcgcgcgtccggcagaaataaattggtcaaaatacacttgagcagcgttggcaaaatctccgtactgtgcttcccacaaaacaagcgtttccggtgaatgcacgttatagccgtattcaaaaccgagaaccgatccttcagacagcgggctgttatgaacagcaaatgatgtgctgcagtcagataagtgatgaagcggcacaaattctttgcccgtctcactgtcatgaagcacaaggtttctttgggcgaacgttccgcgctcggaatcctgtcctgttaaacgaatcggtgttccgtctttcataattgaagcaaacgcgagtgattctgccaaagaccattccacttttctgtcatcatcgaacgccttggcgcgtctttctaaaatgcgctttagcttgccgaaaacattaaatgactccggccagttgatcaattcgccattcaacttgcggagcacatcaaaatcaatcgaagtgtccacatctgggaaaccgtttgatacaggctctggaagttcaatttcacaagcagtgtgttcctttttagacggaactttctgatatgcatcctcaatgcgcttcgttaccgatttttcgatgttttgaacgacttcctcggtaagcacgccttcttttaccagcttttcagcgaaaatttgtttgacggtcggatgctttctgacagcatcatacagcattggctgagtggttgacggttcatccatttcgttgtgtccatagcgtctgtacccgatcaaatcaatcagaaaatccttgttgaatgtttttcggtattcgaccgcaaacttaacagctgaaagacaagcttcaggatcgtccgcattcacgtgaacaatcggaatttcataacccttggccaggtcgctggcatattttgtcgatctggattcagcgctttctgttgtaaatccgatcatgttattggcgataatatgaatcgcaccgcctacttgatacccttttaaagagcttaaattcaatgtttcagctacaattccttccccaggaaatgcagcgtctccatggattaaaatggcaagcgattttgtttcatcttgtaccgggtatccgctttgtgttcgcgtttcctgtgctgctcttgtgctgccttcaacaatcggattgataaattccaagtggctcggattgttcgctaacgtaatgcgcgctgattttgtttcagcgtcttgaagctcccgattcgcccccaaatggtatttgacatcccctgtccatccgtagctgattccaattgatccctcagacgggacaagatctttattcggcgcatgctggaattcagagaagatgatttcatacggtttgccgagcacatgtgccaagacattcaggcgtcccctgtgcgccatcccgatgttgacgcttgtcgtgcctgatttgacagattgtgcaataatgtcatcaagcactggaacaagagcgtccagaccctcaatggaaaagcgcttctgcccgacgaatgtgcggtgcaaaaactgctcaaagccctctacttctgtcaatctttccagcacagctgacagcttttcagctgagttcttctggaacagctcgccagattcaatctttcttgtcagccactcgcgctctttgaagtcatgcacatggtcaaattcaaaagagatggttcttttatacgtatttcgtaaatactgaatggcttctaaaccgttcgtaatgtttttaggagcgtctttgcagatgacagacgcaggtattgcttttatttcctcttctgttagcccgtaatcggataatggaaaaagttcgctctttttctcatcctttctgagcggattgacggaagcgttcaaatggccataggttcggatatcttctgcaagtctgactgcggatgcgatcttttgaatcagatcggctgtaacacgtcccttttcttttgttcccgaggcctcttttatatcgcttggcggagcaccgagctcgtcgaacatttccttcaaatccgggtcaatgctgttcggatcctgggtatactgatcgtaaagctccagcgcatagccgaggttcggaccgtaaaaatcttcccaattcattcgttgtttcatactattttgaaacatttgaatattacccccaacttaaataatcaagtgattgattcactatcttgaaataactttcgaacgctgtgtccaaaattatgtaataaaaacgcttccaacgatattttaccactgtttgcaatttgattctaccttgattgttcacaaaatagtaaaaaacctttataaaaaacaaaaaatttaatcattcgaaaaaacaaacgccaaaaagcataggattaagggctatcctatgcttttatgaagcagttttttcagcagcggatacaaaacatccggtagctgatcaacatccgggacaaatatactgaattttccgtacatatcctggatcgtcttcatttgcgattcttctatttctgagttggagagaaaaacatttatcacttctattcctctttttcgggcttcgataaccgcctcacttgtatcaacgatcccattttgttcgtagccaaatgcggccggctctccatctgagaaaacaattaagaacttttgcgcctcgctgcgatgcagcatttttttcgtcatctgcctaattgcgtacccgtcacggttatcttcttctggctcaagctgcataatggccggtccagaatcttgtcttaatgatgattggaagggaataaccgtattgaaatagtttggctggcttgtttcggttgcatcatttgtgtcctcccaaaaaccgacaatctgatgcggaaccgctaccgatttcagcgcttcgtgaaacaacacgattcctcgttttgtttcgtccattttgtcgaacatgctggcggaacaatcgaccagcaatgtaaaaactgcgtcgatttctgtagacggttcttgctttttgtagaacaggcgcggatttcgctcagtgaagtaacgaagaagcttattattcagtctcccggcatgaagatctgttctcggcaatgtttttttatgttcaagcgttttttgaatcatttgtttcaaacgcttttgatacgattcaatcgtttttgcctgctgtttataagaaagctcctcttcactggttgccggctgcggttctttataaattggaaatgcatatttattttctttgccgtcagccatacccgctccgttcggctggtctttttgagactccagcgcttccagcttggaatagtctttccgtttcgtttgtctggctgatccttgaacagagccaagggcctgatctccatcgtcgccttcccttgaagcatcttttcctaaatctgattttgcgccgtgttcaatatcaaattgaaggaagcttttagacggtgcttctgtttcccggtgccatgtcggcatttcttcttcatggatatcctcatcaccgtctgattgttttggaagcgtgatgtcatcactcagcttcggcgcttttttctcttcttcaaataacggctgttctgcagcttttgcgtaatcaagctcaggcaaaaagaagtaggtgttcaacatgtctttatcgagtacctcttcaagtccgtccatgagatcctcaacaattttcagaacctgccgtgtcgaatctgcttcatacacacgcaagagctgctgctcaataaacgggcgcatcagatcgatatcttcacgcatggatggaagggtctcgagcggcgattccgctgtgagcttgacatagatcgcgcaaaagagcgcatcggtaaaaatgcttcgttccaaatttaaggtcagctgggttgagaaatgttttctgtacatgtcttttcgcttcgcaaatacatgtttcgtacccggacgctcacgtttgatgcattcttcgatcctaatgtcttcaagcagcataaagagctgcttggcaaaacttttaaaggtgagatgacgatggatatcattcaaaaagttcgcaaactcatgcagcgagctatatcttgttccgactgaacgcaggtagacgtcgcttttcagacccgcttccatgtcctcagctgccctgtctttccaaaagtggctcatatagattttcttttcaaatggattgtaataggactgaacgccatactccacttctaccgcttcactcttggtgagtgttttggccaaatcagtcagcatcataaataaaaatgaatcaatcgtgctgtcgttaaatttgataaatttcatcgcagccccctcattcaaacagagtttctgcaatatttcggacggccgctttttcccgatcatcatcaagcttttctacaattcctcgctcaatggcacgacgcggcggaatataagcagctaaatcacatgtatcgattaaagctctgatggacgccgcttcttcagacacctgtccgttatgggcctgaacgatcaagtcagaggaaagcgtgataaatctgtcaatcaatttctcgtctttcagggctgactgagacatgagcacttgtttcagcagctcgcctttaatataaggcacatcaatgatgacaaaacggtttttcaacgcttcattcagaggaacagttccgacataaccttcattgatggctgcaatgactccgaaaccgcttttagcccgtatgacctcgcctgtaaacggatttgtcatcatttttctgtaatctaatacaccgtttaaaataggcagtgtttccggcttcgccatattgatttcatctatataaagaaaatggccttccttcattgcctttgtaacaggtcctgaaacaaactcgattgtcgcctggccagattgattttcaatcgttttataaccgaccaatgcctcagcgtccaagtcgactgaacagttgacgctgtgcatcggtttattaaaatagctggacaatgtttctgccaactttgtttttcctgaacctgtaggccctttcagcaggacatttttccccatggctaatgcaataatggcgtcaaataaaatggcttcatcctccgcctcatagcctgatgttcctataagcgattgaaactccggggaaataggctgctctttatatgataaaagcttttgttgtatatcttccggcaatgttaagtgctgtagttgagttgtcatagacagattccctttcctattcatattccattaacgagtatactaaaaaagcccctgtatgctcaatacaaaagggcttggatgatattactgcttctcgttatttcccaaaagggctccgcagacaatacgcgcaccggaattgccgcttgggtttgtcagataatcgtccgcttgttcatgaataataaatgcacttccgtcctcgtcgagaatatttagtttacttccttttttcagtgaagtgtcaggcgcattcattatgacatctacctttccatcagcaccgacttcaaggttcggcagatctccggcatgatgccccatcggattattgaagccgtgttctttgttcagtggattaaagggaccgcccgctgattcaaaatccggcctgacacaagaacctttctcataaatatgaaaaccgagagaagcacctggacgcaggctgtttgcggaaatatgaatatcgaggccttcatcatctgattctttgatctctataaaaccgactgctttcccttcacgattgaccagctggacatgatgaccaaacgctgacgtttcaaccacttttttttccggcacccggttaggagggtctggaggttttttttgtccgcatccggcaactcccagtgccgtcagcatcatcaacagcaagagacggtgcatactgtctcccccttgttttttctaacagtgtggtcaatcattgtctggtataaacaaaaaagcctataaaaggctttttgtcatactcatttttaaaaataacttcttgcgcccaagtaccgctgtttccaatacgaattgctgagattggaaatgtcgacgcccgatgagcttgcatgaataaaatcaccgccgcctagataaatccccatatgagacgggccggatttatatgtggtaaagaagacaaagtctcctactgacggctggctgactttctgcatgacattccaatatcctgccgtactcaatcttgatatagatgatacattattaatgaggtaataaatgaagccgctgcaatcaaaaccggcaggcgtgtttccgccccatcggtaaggcactccgacatattttttcgcttccgtgatcattctgtcaatcttcgagcctatttgaatgtttgaccctgagttatcttttggctttgttggctttgtcggatttgaaggattagattttgatgctccagaaatagtcagaacctgcccgatttgcagcacatccgatgataaattgtttttatcacggatgctttggacagtgactccgagccgatttgcaattttccacagcgaatcgcctgcttttaccttgtacgtcgttctttttgagggattggagtttgacggctttttggaaccgctgtttccgttcttaggcgaactgcttccttttattttgagcacctgtttaggataaagtgtatctgatgttaagccatttaaagtttttaattcggctacagtcatatttaagctgtttgcgattttccacagtgagtcaccaagcttgaccgtatatgtactttttgaagaacctgaagaattggaaccgctgtttttctttgatccatttgatccgcttgaactgcttgtccctttgatcttaagcttttgccccggacgaatcaggtcactgctcaggctgtttaagcttttaagctcagaaacactcattttatgatttttagcaatcatccatagggaatcaccatatgcaactgtgtatgttgacgttttgcttgaattagatggggatgtcgtgctttttttgctgctttcaggaaccttaagactttgtccgacataaagcaccgttgatttcaatttgttttcggatttcagagctgatattgtcgtatcatactggcgggaaagtttccaaagagagtcaccgctttttacttttatcgtttttgcttccgcgggtgctgcggccatcgacgacccaacaactgcagaaacagccaagccggctacaatcttctttttcattcattcaacctcctaaactgtttttttgtaaaaacagctagtattttgtttccaaaaatggcacacaactgttttatcgtcaatttttcagcaagttaaacccttttcaaacatttggcgcagcattttcagcatcgttcgacctttaaaccttcaaataaacatctaacattttacataagcacgatatgtttttcgaaagtctaaggaactatttaagtgagggtaaaaatgatggttttctattgatgaacgaagcagtttctcctcctttcttgtctatttttctaatcaattctctatcggcgtatcaaatccctcttatgaaatggcaaaaagcctgttctttcgataagaacaggcttttacactatgcatttgctgattgagttttttgttttacagcttcaagaatgctatcggccgcttttttagagccgcctgccgctttcagtgattgtccaatttcttttgccttttcagcatacgaacgattattcattacttcttgtatcgtctctttcagcaggctttcagataattcttctttttttaacacttttcctgcaccgactttttccacctgatctgcgacaacaaattggtcgcctcccatcggaatgacaacgagcggggtttcaaaatacaaaccttcacttgtgctgttcattccgccgtgtgtcacaaataagctggctcttttcaagatctcaagctgagggacatacgggcgtacaatgaaattctccggaatgtcgtttaactcacttgttttaatatgcttgccgatggaaagcacaactttaccgtcaaaatccttacacacttcaaggcattgattaaaaaactgcttttgattattaaaaatggttcccattgaaataaacagcacgttttcattgtcaatctgatcaaatgggaaatcattgtttccggctctttctgtaatggaaggaccgacaaatacatatcgctcgccaaattgctcagccagtggctgaaatccccttgatgtaaagacaattgtcaagtcaccatcagctaaaaaaacatcaaatggcttcttgatctctgcttgaaaatcagcatttaaagtttctgcaagctgctggtatgattcataatgaggcgaatcttcaagtgatcctttcatgtacgctcccatcatttccttcgcaaattcctcattcatcgcaaaggttgtacacaatgaaaatcttggcagcttcagcaggttggcgatgactttacccgcgagaagatggtgatcatatatgacataatcatacgattcatgtttgacttcctcataaatatgagtcgcaatatctttacagcttttcaaaaaagcgcagatcatttcagtaaagtctctttcttcatcaccggttgcgtttttcccgaagtaatctcccctgaaatcatgatactcacgaaactctatatcaagagctgtgattttttctttatattccttcactgcgtagtacgtaatgttttctccccgagatttcagctccttcatcacaccgatagagggattaatatgcccttcaccggggaaaccgatcattaatacatttgccatgcggcagcacccttcctttgaaaatttatataatattttatacggtactataaatacataaacaggtaaagtatttcactttattaatattcatcacatataacttttctaccagtttatattccctgtcttcaagacaaaaagcattcagcttgaagcgaatgctttaataaagatacgaattcagtcattttgtctcatgataggattcttaatcaggccctttttattatttttacgttcttggtgaaattaacggatataatacaccgtctttggcaaacgacatcttacctgtttcctctgaaaccacgagcaccagtgcatccgtatagcccgacataccgagagccgcccggtgccgggttcccaaatggatatccacttccttcgtcgtcagcgggagcacattggctgctgacacgagtttgttttccctcactaataaagcgccgtcatgaagagggtttccgggaaaaaagatgctttcaattaatgaagagctgatctcggcgtgtagggaggtgcctttttgaataaaacgttcaaccgggtctgctctttcaatcacaattaaagctccatgcttatgttccgataaggctttaatcgccttggccagctcaataaatgccggcgtaaattcctcaatgtatgattgcaaataaaaggaggatgcaatcccctgcatgtcctgaaaaacgtgccccaaatcatctaattcacaaaggagacactggtctttttcgtgaagcgttttcaagattagagatgcatcacctaatatttgctctaggtacacctgtattttccccttgaacgcattttctgatatctgctcatagcgcatagccttcatctcctgttcaaatttccaacttttcacgaatgcttatcttattgatgcacattctattggtaaaggagggatgtaaagaatggaaatcgaaagaatcattcagtatatttgcacctttttaggcgtgatttcgctttcttttatttatgcccaaatgtttagaaaaacgaaaccgacaaaaaaagaataggcccggcgttcattgctttttatacataaaatgttataatttctctcgttatgaaaaagaaacggagatcaatgtatgaaagaaactcaaaacgcccgggaaaaaatcaaacagctcttgcacattttaataccgatattcattacccaagcggggctttctctgatcacttttctagatacggtgatgtcagggaaagtcagccccgctgatttagctggtgtcgccattggctcaagcctttggacccctgtttacacaggacttgcaggtatattaatggcggtcaccccgattgtcgctcagttactaggcgcagagaaaaaacagaagattccctttactgttttacaagctgtatacgtggccgcgcttcttagcatcgccgttttagtgattggatatgctgcagttgaccttattcttggccgattgaaccttgatattcacgtgcatcagattgctaaacactttttaggctttttatcactgggaattttccctttatttgtttacaccgtgttgagatcattcatcgactcattaggaaaaacgagagtcaccatgatgattacactcagttctcttccaatcaattttgtattgaattatgtatttatcttcgggaagttcggaatgccggcacttggaggtgtaggcgcggggctggcatccgcgttaacttactggtgtatctgcatcatcagttttttcattattcataaaaacgcaccgttttctgaatacgggatttttcttaccatgtataagttctcttggaaagcatgcaaaaatttgctcaaaatcgggctgcctattgggttcgccgtgttttttgaaacgagcattttcgcagctgtcacgcttctaatgagccattttcatacagtgaccatcgcgtcccaccaggcagccatgaattttgcgtctcttttatatatgctgccgcttagcgtgtccatggctctaacaattgttgtcggatttgaagcgggtgcagcccgttttaaggatgcacgctcatatagcttaatcggcatcatgatggcgatcggcttttctttgttcactgccgcctgtatccttttattcagagagcaaattgcgggcatgtacacttctgaccccgatgtgctccggctgacacagcactttttaatttatgcgctattttttcagctttccgatgctgttgccgcaccgatccagggagcactcagagggtacaaagatgtgaactatacgcttgcggccgcttttgtctcttactgggtcattggccttccggtcggttatatggtcggtacgtttacaagcctcggtgcattcggctattggattggattaatagcgggactcgccgccggagcagttgggctgtttttcaggctggcaaaactgcaaaaacgttattcgcaaaaacaacacatttaaaagaggtgatcaatcatggcaaaaaacaaaaaattattcgagtatctttcccagcatgcggaaaccatcagttcaacatggtatgaaacaatcgaggagactgatcccaattccatttatgcctcaacagaccctgttgtcattcacaatttaaagagccagaatcttgcctttaactataaaataaaccgtatttttatagatgatgaggacgtatacttgcctatactgaaagaatgggcttttgaagtcacacaggatcaagagcatttaaaaactcctatccactatattattcgggagtttgtcagagtgagagatttatatgtttcctatgtgaaagaatttgtccatctcaatcaggatactgtgaaaagcgaagaagccgaagacctgtatcacgcccttataaaagcgtttgatcttgtgattcatatttttatagaagaaatgtacaaaaacacaagccttcagcttcaggcccaaaaagatatgattactgaattgagcgctccggtcatcgtgctgtttcacagcgtcggactgctgcctttaatcggagatattgatacagtccgcgccaagctgattatggaaaacacactgcatcaatgtgcgaaaaaaaaggtgacacaactgtatattgatttgtcaggagtagctgtgattgatacgatggttgcccatcagctgttcagtctgattgaggcgcttcgtttaatcggtgtttcttcaactttgtctggaatccgtccggaaatcgcgcaaacagcggttcagctaggtttgtctttcgaaggtatttccttgagatccactctcgcttcagcaattgcatcggacttaaaattaaaaaaggtataaggcttaaggccttatacctttttgattaatcattccattgatacgtccaatatatttcttcttcaaaccatgttgccataacaggttcattatttttcaatttctcttcaagctctctgagcatgccttctgtttgtgtgcggtgagctcttaacgcattcattttaatatcagctacttctttgatatcaagcacgacatcagcttcgccgagaacctcttctctgttgcgggtaatggccatgcagattgtacgcggacggtcttctttctttttgcgatataatgcacggataaccgcttccccgcatgcatcatggtcagggtgcacaccgtgtccgggataaaatgtgacaattaaacttggttttacatcatctatgatctcttccatgatatcagctaaatactcatcgtcttcaaattcgagcgttttgtcacggagtccaagcatacgaaggtcattgatatccatttctttgcaagcattgatgagctcttgttttcttagcagcggcaacgtttcccgattcgcgaaaaatggatcgcccatatttctgcccatttcacctaaagtggcgcaggcatacgtaacgggaatgtctttttttctgtttaaggcaatgaggcctgccactccatatgattcatcatcagggtgaggcaggattactagtacatgttctttcattattattcacccttttcttttaaactgtgaatggtttttcgctgatttgcagagaaatagccagtttaccgcccggcagatgtcccgccattaataaacggttttcttcatctaccgtgtattcagtcaagccttcagcataaatccagccttcttctgttttcaagccaacgcggtaaggcccgttgcctttgatttttgcctgatgataagtaacttttgcattgcgaatatacgcaacaaccgtcatgttcttttcatttaagtgcgctgaataagaacctgtggtggtttctaaatggatatatacagggcggtccgcatatcgttctaaagatgcttgcacatcttcttttatgatcgctttcatgattgctcccctctttcttcttttaaatactctgcacgttctgtatgtaatttgaccagctgatatttcacagccggttcgagctgtgaattcacaatgcgctgaatcgcggcaaaatatttttccagcatcggttttcggagtcttggatgtgttcgtttatccaacagctcaagatcaatcgcctctgctaccgcttctgcgtcatcatgtgcgagagatcggttattccaaagtgaagcataggctttcactatctctttatcattgtccatcgtcttgctcctttatgtcttacatacatgaaatgattatacataatatatgcatcagctgaaaagccaaaggcctcaatggctttttgacgcccgtttccacttcacttgtgaaaacgtaaacaagatcagcgcagcccatatacagctgaatgtaaaagccttcgagcttgaaaatggctcatggtaaacaaacagcccgatcagaagggtaatggtcggcgcaatatattgtaagataccgacttgatacagtggcagccgtttcgctccttccgcaaacaataagagcggcaaagccgtaaacacaccggccaaaaagagaagcagccacgtccctccgctttctgcacccgctggctgaacatgtccgctgaacagcaaataccctaatgcaatcggcataatcatgaatgtttccagcgttaaaccgatggcgctcggcaggcttgttctttttttgcttaacccgtacagcccaaagctgaatgcgaggagaagcgcaacataaggaatggagccgtattggaacgccgagatgatgacaccggctgccgcaatcgaaacggccactaattgcaggcgattcagtttttcctttaaaaataaaatcccaaggagcactgatacaagcggattaatgtaatagccaagactagcctcaagcaaaaagccatggtttacagcccatatgtatacaaaccagttgatcgaaatcaggatagaagcaagaaataaagagaggatccctccgttctttttcagagagcgcagctcctgccatcctattttccattgccgcaagaaaaaaagtacgatacacataaaaacaaaagaccatataatacgatgagccaaaatatcaagagccggcagctgttcgagaagcttccaatagagcggaaacaggccccacatgataaaggaaacggctgtgtaaataacgcctttttttgtttctgaatattgcatttatatccctgcctttctttagagcatcttatattatatcacgtgaaagatctggcgggcatatactattttgtccgtgaagaaaggatgtgaagacaatgtttgagtggaacaagtactttcctttccacaatcaattttctaaagaagcattaaaaaaagctgatccgaaagaagttgaaacgtatgtcaatcgtgtgatggaaagtgtgttcggcagtgattatgcggctcaatttcctttccgcgatcctctcccccaaaaagaacatcccgccaaacctgatgcaaaacctgatgtcaaacctgatattgatatattcgaaacagcagaccatgtgtttgtaaaggtgccaatcagcgaagaatggctggaacaagtgagaatcaaacacacatctcacgaattatggttggaaaacctcccaagagcagatcatccgaaaaaagtaaaccttccttgtttagtcaaacgcaaaggaacaaaagccgtctataaggatggccttctggaagtcatgtttcaaaagcagcaagactacaatatgtccgaggtagaaatcatccgataaaaaacggcctgcaatcgatgcaggccgttttttattaatagaagccgggatatcccccgtatggcacgccggcaccaaaaccgtacggtccgcctccgtatccataagggccaggaggataggcatagggacgagaatagttaaacagcgcactcccgagaaaaccgcctaataaaccgccgactagaggagcgccaaacaaaaaaggactacgcgccggatatccggctggacctgggattccgcgataatacgaatgatgagggtacatgattttttcctcctttatgtctgcctatacgtaaagtattcagcaaggaagaaaaacgattgggctacggactgtctatgattgttacatcacaagctctgccaataacacacagccgagtcctgtaaccgaaagaactgttgtaagcagcgtccaggtttgaaatgtttctttcatgctcaagccgaaaaattcctttaccatccaaaatcctgcatcatttacatgacacgcaatgacactgccggctcctgttgcaagcaccattaacgcgggggttacactgccagcctccataagcggagctaccattcccgctgtggtaagcgcagccacgggagcagagcctagacacagacgcagaaccgcggcgatggtccatgcaacgaatagcggcgacatgtttgtttgacggaaaaaatcagcgacataatcgccgaccccgccgtcaatcagcacctgtttaaatgctcctccccctcctatgatgagcagcatcatcgcaatttgcgaaattgattctgaaatagatctgctgatttcctgcataggtattttacgggcatatcccatcgtatagagtgcaagcaacagcgaaatgagcattgccgttcccggagtgccgataaattctataatgtcttttccttttgaatgttcattcaataataaagaaaaaactgttgccattgccataaagataaccgggaataaagacgtgacagcactgatcgcaaagcccggtgtttcatccagctgaaattctttccttggtcctaaccccgataagtttccatgcttttgatacgcaccaggaaaacgtttcatcgcaaatttattaaataaaggcccggcaatcacagttgtcggaacagcgatgatgattccaaaaagcagcacctgccaatatgagcaccgtatgcaactgagatagcagttggagcaggatgcgggggcaaaaatccgtgagtaacatttaaggcggcggccatcgggattcccagatacagaaaaggcatttttaattctttagcaatcgcgtaaacaatcggtatcaacagaacaagacccacttcaaaaaacagcgcaataccgatgataaaagaggcaactacaaccgccgcctgtattcgtttcctcccgaatttgtcaatcagcgtaatggcaatccggtagccgcccccagcatcagagacaagcctcccaagcatcgcgccaagtccaaacactaaagctaaatgccccagctgcccgccaattccagtctcaattgaaagaacaattttattgatatccattccaagtccgatggctactaaaaatgaaacgacaatcagtgagacaaaggtatttaattttactttaataatgagaaataacagaatcagcactccgacagctacaattaaaatcggcatggaaacccctccaaaagtgttttatatgattctcgcgacattgtttcggcgcttttcatgcctagatgaatagaaaacgctttcatttataaataacaacgtcttggttatatgattgttatcttttgatcaactaatatgttcatactaatctcctaatcaatgactgtcaatcgtttttatgagcttgtctcgattatctaccgcctaacctaatgattcgttagttatatgttgattaacttttggttatatgttatgttttttaaagttgactgccaatcattatatctctccattgtctgaaagcaaacgagacaatatgagaacagacggataacaacttcacaagaggaggagtacacatgccattattgcgttttgatgtaattgaaggccgtgacgaaaaatcgctgcaattgttattagatactgctcaccaagcgatggttgaagcgtttggtgttccggaaagagaccgttatcaaattgtccatcagcatcccgcaaacgagcttataatccaggatacgggattagggtttcagagaaccaaggatatggtcatcattagcatgacaagcaaagcaagaaccgaaagccaaaaggaaaaattgtatgctctgcttgctgaaaggctagaagaaaaatgcggaatttcccctgaagacctcatggtatctattactgagaatggtgacgcagactggagttttggtctcggtgaggcgcaatttttgaatggaaaactataagatttcgtctccccacaaaaaaaagaagagagagctccaatgaagctctctcttttttcataaatgcggaagtcatcagtatagaagcatccagcaatacgaaaaacctggatttccttttatatccggtttaaatgccaattggaagctgactgggttttggccgaaaatataaaattttgctgatttgcataataagatacatcataatccccatttacaataggttggatgttatagcttattgatcatttcctattttatatatccccttcatatgcacatgacacttttgccaatccggaaatgtcaatctgacaaatataaaaagtcatgtaaacgggtgtgaaccgtacttacatgactcaccatggaaacaagagcgctttttcagacgccgctttccttatttctcttcttcacacactgtgtcaccaggctcgcaaaattgatcggcccatgcctgcatctcttgaaatacagcttgaagcgctgttcctttttcagtcagcgtgtagatgactttgaccggcgtttcagggagaacctgccgttcgacaatctcgttttgttcaagctccttcaagcgctctgccaacattttttggctgatcatcggtattgtttccgttatctctttaaaccgtttcggcccatccattagcacatggatgatcagaccgttccatcgttttcccagcaatgagaatgcggattccattttagggcacatcgtatttcccacaagtcttcatcccttcatctattgattgacatgtattcaatgatccattacaataatctttcaagttacatttagtaagcttctaacttttctattatcataccacgtttatccgaaggaggaaacactatgacgaatactctggatgttttaaaagcacgtgcatctgtaaaggaatatgatacaaatgccccgatctctaaggaggagctgactgagctattagactttgccgctaaagcgccttctgcttggaaccttcagcattggcattttacagtattccacagcgatgaatcaaaagcggagcttcttcctgtagcgtataatcaaaaacaaatcgttgagtcttctgctgttgttgccattttaggcgatttaaaggcaaatgaaaacggtgaagaagtttatgccgaattagcaagccaaggctatattacggatgaaatcaaacaaacattgctcggccaaatcaacggtgcttaccaaagcgagcaattcgcacgtgattccgctttcttaaatgcttctttagctgctatgcagcttatgattgccgcaaaagcaaaaggttatgacacttgcgcaattggcggatttaacaaagagcagttccaaaagcaatttgatatcagtgagcgctatgttccggttatgctaatttcaatcggcaaagcagtgaagcctgcgcatcaaagcaaccgtctgccgctttcaaaagtatcaacttggctgtaaggatatgaaaaaccttagtccgaaatccggactaaggtttttttatacaatcgcctctttgtaccattcacgagcctgttcagcttcatgctgagtcagctgatggcccccgtcctgccagaaaacggaggctgatgccccgctgtcacgtaaatagcggtaaagctcttctgattcttccttcgtgcaaagaggatcgtatttcccggcaccgataaaaacagggagccccgccatatcaggcagctcgataccccgaatcggaaccattggatgatgcagaatagccccttttaacacatctttataatgaaaaagcaggcttgccgcaatgtttgcgccgtttgaataaccgactgcaatcactttgccgcgatcaaactgatgcgtttctgcagcctcgtcgataaaatctttcaattctcttgtccgcaccacaagatctttttcatcaaaaactccttcactcagacgtttgaaaaatcgcggcattccattttcaagcaccgatcctctgacaccaagcaaatgggcattagggtctataaaccgccccaatgaaagcagatcgtgttcattaccgcccgtgccatgcaacagcaaaagtacgttgtcagatgttcctttttcataaatatgcttcattataaattcccccttttaaagttcaggtaaaatgtctgtaatttggtgtctatgtttctccagccattcaggcagttttaaggaagtccctagctcagaaaacgtttcatctgtcataaagcccggttcatctgtggcaatttcaaataagataccgcctttctccctgaaataaactgatgtaaagtattccctgtcgagaatttctgacgaaggcagatggttttcagcaataatcggcagccatttcgcctgttcgtttttctttgtccgaaacgctatatggtgtaccgtaccatatcctccgactcctcttttttcagggtgtaaatggacatcaatgacaccgccgacggccgctgaggttgccagtctgacaatctggtcttcttcggccactttggtgtatccaaagctttccgttaacaattgtatggtcgcctgcgggtcgtaggaatatagcagcacacctttcattcccgtaattgcttcatttgttgtgatcccgtcaggcgtccactcgcttttgccgcttttcgcatcctccatgatcgccagcggaaggtcttctgtatcatcaaaaataagacctttttcaccaaacaacgttttttcctctaggctcagcccgcttttctcaagacgctccttccaaaaaaacagggagcctgagggaactgaaaagtacacccggcccgcttggccttttcctaccgttccctgtccgcttccttggaacggaaaaaaggtcattattgtaccgggatctccgttttgattcccaaagtaaaaatgatacgttccgggatcatcaaagtttactgtttttttaacaagcctgagcccaagcacttctgtataaaatcgcaagttttcttgcggatctctggcgaatgctgtgacatggtgcaatccttctgttttcattttctcactcctatttatctcgatttcaagatatttattattttaaacctttattgaaaaggatgcaaaccatgtgttttgattaaataattgaaaaaatcatttttttctaataattatcttgtgatcttttcttacaactgctattatagtgagcattatcatgtttcaggaggaaagtaaatggttaaaaaagcacttattgttattctcattcttttgccattcgttcagctcgcgcttttgccgcttgtgaatcgaatagaaccgattatgttcggcctgccgtttttccacttttggctgctgctgtggattattgttacgccgttatgctcgtttggcatttatcagatgcaaaaaaaagatggaggacttgaataatgcaagggaatctgactgcacttctcattactgctattattgttttaaccgttgtctgtatcggctttctcgccggaagagacaaatcctcacgcacttctgtggaagaatggtctgtcggcggcagacgtttcggcggtcttctcgtctggtttttagtaggcgctgacctttatacggcctatactttcttagggttgaccagtactgcttttacaggcggaagtgttgcatttttcgccattccttattctgtgttggcctactttatcgcctacttcttcttgccaaaactttggaatgttgcgaaaattcataaactaacaacactcgcggattatgcccgggaacgttttaacagtaagcttttggcaagcctcgttgccatcgtcggggtactcatgcttattccgtacatatgccttcagctgagcggcattcaagacacgcttcaggttgccggcactggctatattaacgtaaaattcgttgtgatcatttcatttattcttgttgctctttacacattcttcagcgggattaaagggcccacatatacagccatcattaaggacattttagtatgggtcattatgctgtttatggtggtgtccctccctctcattcattttaacggctggacgccaatgattgacacgttagtgaaggaagcaccgcaaatgctgacgataccggcagaagggccaaaaggcattccttggtttatcacagcatctattgtttccgctctggcactttttatgtgggcacacgccgctacaggagtttttacagcgaaaagcgccgatgcagtaagaaaaaacagcatgtttttacccctttacaatattgtgttaattttggtcatttttcttggctttatcgcctttcttatcctgccggaagatacaaatccaagactcgcgctgctgcatttgattcaaacatcttacggcggcgtggcacaaggttttgcatatgccactatcgctcttgcttcattaataccttgttccattatggcaatcggcgcatcgaatttattcgccaacaacctataccgggatttgattcatccgaatgtgtcgcaaagcaagcttactcttgtcacacgttcaatggtctttgttgtcatcggtctcgcgctgctgtttggaatgctgttcccgactgccttagtgacactccagctattaggtgtatccggcatggtgcaaatcttcccggcgattgctgtcagtctattctggaagcatcaaacgaaagaagcgacagttattggattattagtcggccttgcggttacgtttattgtgtataccactcaatccgcacatggcatttatgaaggattctggggattggccgccaacatgatcgctgtggttatcctgaatccgctgttcgttaaaaacgcgggatccaatcctgtcattgaaggtttatttggcaaaaaacaagacgctaatccaaatcaaaagggtgcataaaaaaaccatacgcggcagccgcgtatggtttttttacatttcttttttcagtgtttcaattgccttttccatttgcgtatcattatcagacagcttcttttgaagttctatcattaatttcgttgttgtatcgccagtcagtatgcctgtttctttcagctcctcttttttctggaactgtttgacgacagatacaaaatcctggtcatacgtactgttaacgtttaccttgtaaccaagtgctttgagcattttctgagccactttgacgtttgtgcctgtatcacctgatttgtacgttttatctgcgtccaaatacggcagcttcgcgtaatcaggcagctcagctttcacttgaggcttgatgccttttttgtgaatccattcgccgtcagcagtcagccatttggcaactgtcagtttgacagtagagccatcatcatattcttttgccgtttgcactgtaccttttccgaatgtcgtctcgccgattaacggtacgtttgacgattcatgaagggcagcggccataatttcggctgcgcttgctgtaccgtcatttactaaaacgacggtcggcttggtcactttccgttctttttcggccttcatgacttcttttgaaccgtttttgtattcaacctgcatgatgtttttccctttatcaatgaacaggttgctcatcgtaatcgcctgttccattaagccgcccgggttgcctctcaagtctaaaatatagcctttggcgccttttttctctaaaccgtcaatcgcatctgtcagctctttagctgttgtttcagagaaagaagtgatttgaatttctccaatgttgttgtctttcatctctgaatagacagtctctacaggaatggtatcgcgcttaatggaaagatcgatattccccactcccgctctgttcagttccagcttcacctttgtgccctttttgcctcggattaaagcgacggcttcatttacattcatgccttttacgctttttccatttaccttaatgatttggtccctcggtttgataccggctttttcagcaggtgaacctttaattggggatacaataaggatttctccgtctttctcctctacttgggctccgattccttcaaaagatgctgaaatcgtctcgtcgaatgatttcgcttgctcttgatccatatatgtagaatacggatcatccagtgattgaatcattcctttaattgctccgtctactaatttgtcatcatctgttttttggtaataatcacttttgatttgctcatacgctttatttaatttgtcgaacttgctgtctcctgtgcttgttgatttttggcccaggatactggaattgcccgtaataaataaagtaagcgccgaagcgacaactgcagtgatcagcacaataaaaaacagttttaattgccgtttcaattaaacaccacctttttcttcttacattattatcatggacgaattcttattcgtcaactcggagcagaaatgaaagagaaacgcccttcttttgcttttcataaacctatgtctttatacgacatatgataaggaaaaaggaggattcgatattgagccgatatttagaaatgctgtccttattcggtgtcgcaggggcgcacccaggcggactggctttttcaaaagcggtcttgcaaaaggctgcaccctctccgaatcagccgattcttgatgccggatgcggaacaggacaaacggcggcttatttaggacatttgctgtatcctgtaacagtcgttgataaagatcctattatgcttgagaaagcgaaaaaaagatttgcgaatgaagggcttgccatccctgcatatcaggcggagctggaacatctcccgttttcttctgagtccttttcctgtgtcctgtcagaatcggtcctcagtttttcacgcctgacatcctctcttcaagaaatttcaagagttttaaaacccggcgggatgctgattggtatcgaagctgctttaaaaaaaccgatgccccctgcagaaaagaagcaaatgatggatttttacggatttacttgcttacatgaagaaagcgaatggcataaactcctaagatcctatggctttcaaaaaacagaagcgatgacacttcttccggaagacatggaatttgaaccaaccacagaaatggatttatcgcaaacgattgatcccatctattacgatacgcttcaaacacattatcagctcatgcagttatatagtgagtacatgggtcattgtatttttatcgcgtacaagtaaaacggcgtatcgccccctgttttcgtccaacctttttttcctatctatcatatgctgatagaaagtcaggataggaggggaacaatattggagagatattatcatctttgcaaaaaccatcaaggtaaagtcgtcagaattacagagagaggcgggagagttcacgtcggcagaattacccgtgtaacaagagacagagtttttatagctccgaccggcggagggccaagaggtttcggttacggatattggggcggttattggggatacggagcagcttacgggatttccctcggtttaattacaggggtcgctcttgctggtttattcttctggtaagcatagaacaaatgctagattcaccagacacaatgaagcccgcttatctagtgtaagcgggcttttcattttaaattttcttcactttttcaaagtactcttctagcgttaaatcattatcttggatgacctttgcggcttttttgcctacatagcgcagatgccatggctcatattcatatttcgtgatatcttctttatttttcggatagcgaatgataaagccatatttataagcattgtcctgcacccatttcccgtctgccgtgcttccgaacgcttcatttagctcaaagccattgctccggctcgaaatgtccatcgcaaggcctgtttggtgctcgctttccccggggtaagcgaccgcttcctttgccttcttttccccttttaggcttacttcattgtcaaaaatgactttctgtctgtcatacgaacggtaccctgagacagctgccagttcatagccttcctttttggcagcatcgaacattgtttttaatgcgtcggccgcttcttttctgatgtaacgtttttgaatcttttcttcaaaagaaaactctacatcaggtatgacaagatcgctaggttcatagtttccgggcagtgcatattgtttattgacaagcgcgagtatattttctggattttgaatggtttccagaccatcgacttttttaatatcattgaaatactggctttccaatgaaaactcactgttttgagtgtttgattttttgctgtcagctgttttttgttctgtttgctttgtttctgctgtggttttcgtatccttttgagcatctccgttcgacatgctgcagccggctccgactattgccgttacactcagagcggcagccagtgagaaccatttaccggactttttcatattacattaccttccttttatcaatcgtttccgcattcataaagaagaggctgccggcacccagcacgcctcttgatatattttattgtgatacggaatgtaaagccacttctatcatatcatgaaatgtcgtttgacgctcttccgctgtcgtttcttctcctgttaatacgtgatcactcacggtgagaattgacagggcttttcttccgtgcttcgctgctaatgtatacaatgcagttgtttccatttcaacgccaagcacaccgtattttgcaagtttttcaatttgcgaatcgtcgttgtagaactggtcagctgtaaatacgcttcctacagtcaccggcacacctttatcctttgcggcatcataggcattttttaaaagctcgaaatctgcgcaaggcgcaaaatcaatgcttccaaaagcgactctgttcatttgtgaatcagttgaggaggtcatcgccaaaatgacgtctcgcactttgacatctttacgaatagcgccgcaagaaccgactcttattagattttgcacatcgaagctttgaattaattcattcacataaattgaaatagacggaacacccattcccgtgccttgtactgagatttttttacctttatatgtacccgtaaatccatacatgcctctgacttcattgtagcattctacattttcaagatacgtttctgcgataaattttgctctgagaggatctcccggcaaaagcactgtatccgcaatttgtcctttttcagcacctatatgtacactcatctcatatcctcctgtaaatctaaattatcatccagcccgtccattttacaacgaatgtcatgatgaaacaaacttcagcattgattataaaggaatatgtcgaaaaaagaaatgttcgaggatctgtttggcacttcctcagaaaaacggataatcggggtgttaatttgaaaacctaaccgcaggaaggaggggtgggacatgggtaaaaaacatcgcaaccggatcaccggccaaaaaaagaacaatcatatacctgaaaaagatatcattgcagctgaagaagcacacgggaaagaatattctgctgccaaacgcaagccttaaaactgcagaaaactgcgggtttccgcagttttcttttcattatgtcgtttgtacaatcagacgattgattttcctccagccggcgggaagcagttgataatatgttttcccttttctgccttcatcaatcaggatcacgtcccctgtggccataaatcttgcatcataatcactcggaacagtgtcgaatacattaaacaaagagaatgctcttttcagcacgtcttgatgatcgctcccgttcagttcagttcgatagacggctctgtagccctttttttcgccaaaccggggtgtctgaaatattgtcacgtcataggaacaagacttctttttaaacacggataacatcatcaagatcccctcccttttatttctttaacatattggcgtttttgctgtgttttcctctctctatttttgtcgaaaccgcttaatcttttcgtcaaaaccttttactaggaaaaacagaagcaagccgaggctaaagccgcctaacacatctgtcacaaaatgaacccccagatacactctgcttatgccgactaaaacagcaattacaccggctatgatatataccatttttttatgcttggacaaaaacgggaggtgtttcactaaaaagtaggcaataacaggatagacacaagcagcattcatggaatggccgctcggaaaactgaaggatgattcatgaaccagcggtgcaaaatcaggcctcactctttcgatccattcttttaagactttgtttaacagccgatctgtgccgaatactaagagcatcaacaggccgtcccatgtttttctgtagaaaaacatgcctgctccaatgatgacaattagagggagcagaaaagaagaagcaccaagatgcgtgatccccgtcatgacttcattaagccatggctgacggatcaaaacagctgccttgcttattgcttcatctgcagattgaacagcatttgtatgaatggccgcagctagaatgagaaagaaaagaaacaaactaacgggcttgtacaatttaaccacctcaattttcacagaagtcatagaacatgaataataaaaccggagctgacaactccggttttaagcctcactcatcttcatccagctcttcatctatcatacatttttctatcaaataatcaaaggtgatatcagcgatttcaaacagctcatcctcactcggtatgtagccccgtcttgcaagctctctgtaaaaaaattcagcgatttcttccgtatcaatcacaagatctatttctttcatctccgtaccgcctccttttttatgttttatgaaaaaacaggctgaattatacccggtgttctaaacaattctttcagtcatatattgaataaaaaacgagccatgggaggctgacgctatgattgctaaaatgatggaagcactggacggagaaagatttgatatcataatggaaaaaacgctcaaaggaatgacgcgtgtgatgatttggggctgtctgccatattttttatatgtcttgatccgtatgttcacaaattaactgaaatgctcttttaaactttccaaaacaaacatcatcatgtctttatattcttcatcctgaaacatttcgtacagaattttgtagtcattataaatatccagaagctcatcaacaattgacacagcaaggatgtgaagggtatcttgatcttcatcatcgccttcaaactgaagaagagcagacgatgcgatatcttcgccgatctcatggccagtttctccgacataatggacaaacaacagctgatgcacaaactggtccatttcatattttctaagcaccagcgtgagatcctcttcctccgtttcaagccactctccatcctttaaacgggtcagctcataaatgatatcttcccagccatcttctaaatatctccaaatttctgttctatggccgataatgcgaaagagttcttttccataatctttaacataaacaacgtccccaataaggaattcatactcaatatcaagcttctccatgtcgacaatgacaccctcataatctttataaagctgaatagatgattcaaagtataaaacttcgttatgattgacttcataaagatagtgtttatcaatttggtgtacttttgtgatggtgccgactgttccatacataatgacgactacgatatcccctacttggaatttcggtttattttgcttcatggtgtctccccctcgccgcaacatttctcatacgctatcgtatgccgggtgaagccaattcgcatgggcatgaaaaccaaaggaaatatccaattatggtatgggtatggacataaaaaaatccgcagtgatctgcggatgaaacagctattatctgccgtgcacttcagactcgtattgatcccaagcttcatcaaacgtcgccatcgtgtgaaggtaatcagcattcagctccaaatatgaactgatttcatgataatcggttgatgtttttggaaagctgtgatcctcatacgcctgattggcaaattcactgatgctgtccttcggcttagggtgtctgtatttcaataaatagtgataaaaggatttcatgggtttcccctcctggtgtctgtcttttgttgttctattatacagttcaagtgtaaaattacaacaaaagaatactgaaacatgactcaggagaagtcaaaatagttgcgtttcaaaattctttctgtctccatgagctgctgatatgtcaggctttcaggcagtttttttgtttgaattaaaagcagctgatcctcaatctccttaaccgtgttttcctcttgataggtcataccgcaggaagaacataccatggcaggggtgtctgtcagttctatagccctcgttccatcagggagctcccagtacaccgtgttcctgccgggcaccgcttcaagcttgccgcaccattcgcatgttttcatgaagaatcccctccgcattcagtctctttctgttttttctgctgcgccaaaaatttcttttctttgagctgatctcttttctcacgccgattttttaatgtttcatgctccggatttgcgatgtatgcctctctccttttgattctgtctacattttcaggtgtaaacgaaacttctttgtcagcaaaaatggcactcagcccgatcggctcctttttgtcagcggtttcagggaaaacggactcaaaataggcgtctgcctgattggggatataattctctggttccggatatgacgtaatcacaccttcaaaatttcttaagatcactttgtcaggactttgtgacagtacatagtttggctgcagggcgattttacctccgccgcctggtgcgtcaacgacaaaggtaggaaccgcatagcctgaggtatgacctctcagcccttcaatgatctccaaacctttggaaacaggagctctgaaatgtcctattccttctgacagatcacattggtaaatataataaggacggactctgatttttaccaagtcatgcatgagctttttcataattggaaccgaatcattaatacctgctaatacgacagcctgatttccgaccggcactcccgcgttcaccagcttttcacatgcctcaacggattcttctgtcatttcgatgcttgtgttaaaatgggtgttcagccagaccggatgatattttttcaatatctcgcacagatgatcggtaatgcgctgcggaaagacgacgggcgctcttgttccgattctgatgacttccagatgcggaatgctgcgcagctcttttaaaatatattctaaaatttggtcgttgatgagcagcccatcaccgcctgaaattaaacaatcgcggatttcgggtgtttcccggatataagcaattgcagcatcaagctgttttttggggactcccattccgatttgtccggaaaagcgccttcttgtgcagtagcggcagtacatggaacattgattcgtgacaagaaacagcacacggtcgggatagcggtgtgtcagaccgggtaccggtgaatcttcatcctcatgaagcgggtcttccagatcgtattttgttttgtgcatttcttcagaaagcggcacagactgcatgcgtaccgggcatctcggattgtcggggtccattaaagaagcatagtaaggtgtaatatttaaggggatcgttttggtagaaattctgacgccttcctcttcatcctcggtcagattgatgactttctttaaatcatctaacgttcttacagtgtgtgtcagctgccaaagccaatcgttccatttctcttccggaacgtccttccataactcgatctccttccaatgccgtttcggtttataccatttgtttttcaaacgaactcctcctcgcgcatattttgacttacagttgcttgcaccaaatattcatgttttcaaggccttcggctataaagcaattattgatcagccttccgccatactgataacctgaatggtacaacacagcattcatcccaaaagacgaagcacgggcgagagaaaatacatgaaagatatcctttccagccatttctttttctaacgcctcgattaaaaagcttgttaacgaatggccgcgatattccggcagcacagcgcaatcggttatttctgcatgcccaagctctggattgatttctgcgcttgctgcgctgatcaggcggtcatgatcaagcatgatataatacaccgtatttgcattcatcgtcttttcaatataagcggggtcaaataccggggttgggtacgtgcggaatacttttttatacagcatcgatagctggtacatgtcgtttgtttctgcttttctcatcgtaaaaacgggtgtactgtcgttgcgaagacggggcgctgtgcgatatatggcttcgatgatctcctgttcctctgtataagaatctgtttgtctccggctttctgaaaggtaacgtaccatgacacaagccgaatggccgagataatagccctttagatagccctccggcgcaaataattgtttggcaagcattggctcatcatgctgcttcgcatagacgatgattttttctgcattctcttcttttgccgctgccacgatatccggcagggccttctcaatggctccgtcataacggaccactctgattcgtttattaaagccgtcatggtccaaaactgctgtgacaccgctactctttattgacttgagcatccgcatcctccccatctgtatgaagcccgcaccaatccatgacaaaaagtgcaataattttagcagattctatcatggcttcaacctcaatgtattcattggcctgatgagccgtttttgtttcccccggcccgaaaacgatcactggtgtatctcctgcatggtacaaaagccctccatccgttccccacggggaagcctcaataatcggctctgtctgtttcattttttgataggctgattgcagcacagaaattaaagggtgatcatcaggtaaatcattcggcagccattgagcgccaaaccattcgacttgtacgggatggcgtttaaaccattcgtcatggtattctaaatccttcagccagttttccaattcaagttttacagcttctggtttctcatggggagcaattccgcatctcccttctataacgacacggtctgcaactgaagatggccaggcaccgcccgagatcgtgccgatattcatcggtaccggtattgggatattgtcatacagcggatctgaaattctcgcattgcggactttctccagctcttgtatcgctgtgataacgtgcatgcttttttcaatcgcgcttaccccttcatagcgtgtgcccccatgtgcggctaatcccttcacagtgatccgaaaccacatcgaaccctgctgcttaataaatagtttcatattcgtcggttcaggaatcaacgccccgtcagcacgatagcctctcatgatggcggacagtgtaccggcgccgccgcactcttcatctacaacactctgaaacaatacatctcccttcaatttgacatcgcaagcgtgcagggcttctaaagcaaaaagaagggctatattgcctcccttcatatccgttgagccgcggccgtatattttaccgttttcttcgacagcttgatacggttcatacttccaatcctttacgcttccttcaggcacaacatcgatatggccgttcaaaatcagggacctgcctccgccggctcccgtttttttagccacgatattcgggctctcatgaaaatcggatcggttagatttaaagtagggatgctgttttaattgctttatacttggctcccatacatcaatgtccatatgaaattgccgcagcttttcaagcacaacagcttgggcgttaaactctgaccccaatgtgcttttttccccaatcagccttttgagaagacgaatggctttggccgaatgctgatcaagccacccgattacttttctttcaatgtcttgcatcctcattccccctcttaagaaaaaggcatatctattttgatttcagcatctgtcagcctcgtcacctcatcgattgtcgagccattcatcagctcttttaaaatgaagtgatggctatcgacctcaagaaccgctttttcggtaataatcaaatctacacagcctgcagcagttaatggcagcgtgcatctttctgttaatttaggccttcccttttgatctgtatgactcatgacgacaaccacttttttcgctttttgggcaagctccatcgccccgcccataccaggcaccttttttcccggaacaagccaatttgccaaatctcctgattggctcacctgcagggcgcctaaaatcgtaatgtcaattttgccttttctgatcatcgcaaaagacatggttgtatcaaaataagaagccccttttacagcgcggacaggatagcccgcggcgttgcataaatgcgcatcctcttctcccttttcgggactttctccaatgccaaggacaccgttttccgcttgaaacatgacctgcatgtcaggcttcaaaaagttcggtaccaaggatgggataccgataccgagattcacaatcatgccctgcttaatttcagtagcagcccgttttgcaatctgttctctttctgctactcccaagcccatttccacttcactccctcgcttcttacaactccctcaacaaaaacccccggtgtgacaatcatttcttcagaaatctcacctatcggaacgatacgctcagcttcggcaaaggttctcctggcggccattgccataagcggattcatattgcgcgcggttttgtcatacgttagattgccgaattcatctgcaatgtaagcattgatgaaagcaaaatcagccgtcagcgcctcttcaatcaagtatcgttttcccgccactgttacgatgtcctttttttcgcaaaccatttgattatcaatgcccacgtcggttaaaataccgccaagccccgctccgccggcgcgaatccgttccgcaagcgttccctgaggtgaaaattgaacctctaacgtcccctctgtcatctgttttccggctacaggattggaaccgatatgcgaggcgatcagggttttgacccgttgattaacaataagcgggccgatccctatatccgggaaaccggcgtcattgcagatcacagttaaatccgttacaccgctgtccaatatcgcttcaatcaatgaaggaggcgacccgactcccccaaaaccgccaaacatcagaaccgatccatcccgaacatctgcaattgctgtgtcaatgctgattgctttttgaaatggcgccatttaatgtcaatccttttttaagtttttttcgaccgctgcaactgtttctgaaaaaatagagataagctcttccatttcaacgtctgaaatggtaaaaggaggagcaataatgacagcatctccttctccactgtctattccagctttggaaggataaacaatcagcccgcgttttttcgcctcgctgacaataagctgggttaccgcctgctctggcggaaacactttcttcgttttttggtctgccacaaattcaatgcctaatagcagtccttttccgcgcacatcacctataatgccgctttgagatgccgcctcatcaagctttttcttcagcacagcgccctttttttctgattgtttgatcaagccgtgctttaacacatatcgcaaaacttcaagagcagctttggctgaatagggatgtgcactatatgtgtgaccgctcataatcacacctgacccttgttttatcgtttcaataatagaatcagatacgacggcagcggcaataggtgcataccccgcaccgagtcccttccccagtacagcaatatcaggtacggtgtcccaatgctctgtcgcgagcatccttcctgttctcccaagccccgtcatcacttcatctgcaataaaaagcacatcgtgtgtgcggcatacctcacttaatctctcataatatcccggaggcggagtaatcgctgctcctgcagcaccaataataggctcagccacaaagccggcgatgaattggcttccgattcttttgatcatagtgtccagttcatcagctgcagtctgaacaaagtcttcttccgtctcataattcagccgataaatatgtggagctgagatagctggataccgctcaatgagatgggtgaaccggtatctcctttcataaaaaccagacaatgaaagcgctcccaaagttattccgtggtaactgctccatcgagacaaaaagatggatttttgtgtttgctttttttcctgccaatactgaatggcgattttcatagctgtttctatcgcttctgacccgctgttgacaaaaaaagaccaattcacatctccgggcagctcctgtgccaagagagcggctaattgctcggcgggctcactcgtaaactgtgagcggtaagcaaaagacacctgatcaagctgttctttcagcttctcagtcacatcacgaactccgtggccgatattacatgtcaccgcacctgacgagccgtcgagatatttttttccggtctgatcataaacatatgaacccttcgcataactgacaaccggataggccgagctaagctctggcttaatcaaataactgctcatgctcccacctcaaaaccccttttaccatattgtatgagtgtccaaatggcggcatgacgttccccgcaaaaactttttcacataaaaagagccttcctaatagggaaggctcttttgaaatttcagcatctagcaaataaaagcggctccaacaataattaataaaatgaacaagacaacaattaacacaaatgtatttgtcccgcagccaaatccgtaaccgtacccagagtatccatacatgctgttttcatcctttcttatcacgatatacggcattttatgcgggccaagtcccaaatggtttgtgcaaacgcctatttcatgtaaggaaataatgaaatacagtatgcacccgctcatattttttaaacgtcagcttttcgtaaaactgagttgcaccgtcagtgcttgcagccactaagtaggctgcttccattcctagtgatttggcgatggacagcatttctttcactaagatactgccgtagcccttcctttgaaactgatctaaaattgccacttcttcgattttagccgttttctcttgatgatcgataaacagctcgccgcacccaatgggaactttctgtgcctggtcgctgtaacaaacaacaagaatgattatacctgcttcatagaaaggatattttctttttaatttttgttcagcgattgcttctccaatataaatggaatcgtaaattttcataatagaagatccgtcgcaaagactttttgccgtcccccatgcggttaaaggatgtcccatctgccccttccagtcactaagcttcatgtcatatagtagctcatcctcgacgacaaaaccgctttttacaagcgactgcttcaaaccgagcggaaaaacatgctgcggcgacgcttttaaatggagataattcgcatcaagcagctttggtacggagggtaaaaagttaagtaaccgctccaatggaaacgtatcatggagctgaacaaagttatgagaaaaaatgtgcggaagctgcggatctctgtatacgctgtaatgatcaaacgatgccgattcagacgttaacaatatatattgatgttccgtttttgaataatgtcctgtcatgaacgtctcctttttatgacctatacctttactctgttgcaatattcaatttctttataatctcatcgtacaccggataaaacggctttccaattggaaattgctgaatatttcggaaagaagcggagattggcttctgatgtaaaaaaaacttccttgttacttgttcactaatcgggtgaaagacgccgtttagaaacaaaaacggctcgcgttcgatgaaaaacagacgtcggccaggcggatttttgatcaattcagatcgtttccacgtaatcggcggcccttccggaagcgtctccatctcttcttttccaattgtcactatgtcttttctttgaaattgataaaattgaaacgcatactggtccacgattcgccttttttttccagcttcgatataaaatattgcaggatggtcagcttcctttactaaaatataattcggaatgtttaaaattttgccaatcctatattggaataaatatgggtctggaacagcgacagtccgatttagatacaaaaaaccccacttttctccaacaggatgccttacaccctgatcaaaaaaatacacattttgatctgaaccttttacaaaagagccgtcaatcaaatcggcgggcagaaaccgatatgcattttgaaatgaatctggggttttataggttgtgtctaatacttcatttatcggcagaaatggggtaaagttgttgagtctcgcccaaaaaattgcgtcgccatgattccaatgcttcatatcatcatcccagtagcctccaaatttatggtggatgagattaagtaacgaacggcgatgcataacggagcaatgatcaacttgaaaagcggcctgatcaagcactgcattggcatttctgtagaaatgtgagatttcctctcccctttcgtttacatgtacaactttttgttttgaatagaccgcctgcgcttcaggcttatgtgaaaactcttgcatcatacggctcagccgctcaggatgataaacagtgtcgtcagtaagataggaaatgtaatcgccgtctgcaaatgggagcgcactgttaattaatgtggcataacgagctgtttttaatcgatctgcaggatgcacgaaactgttatgatattgaatgcgccggtcgtggagatacttgtgaatcaccgcagttgtttctgcattcgaatgatcatccatgataaaaagctcccaaagatcatgcgtttgctgtatcacgctttcgatcgctttttgcaaataatcgggtttgttgtaacttgttaaaataatagacactttctctcccatctataccgcctccctccgtcaaacataaaaacggctccgcagcaagcggagcctctgtcatcatttaaaaagcaccccagcttacaacacttgagagtgaaacatgagatctcgtgttatttaacgggttttggaaaataaccaaatcagtcagaacttcttttacgatgacattttgaagtgtatctccgttaatcaaattgacttttgaaaccggtacgcccagctcttttgcaaaaacaagctggcgtctgaggtcagatggatttccttcagaagacgattgacgtatcagcagaatcagcaaaagcaaaataaaatgcagttcatcttgattttcttctcgatccacttgtttctctaaatccaaatcatccctctcccttatccttatctctgtttcacaatatgtgcgactccgatttatggtataggctatgtccactccattaaaaaatcagcattttccttaaatagatgaaaattagatcaggtacggcgttcgactcataccaaataacagccggaagaatatgattaacgtgagttcactatcgaataggaggtgtgtgtaatgagctctgaaaatgcacagttaaaaaaggatttaattaaagccgttttaagccctttatttccaactgcaacagaaggaggagaaaacatggatagtaaccttaaagacttgcttgaagctgccatcgatcaaagagtagatgaaagtgagatggttacggcagaatctcttttagacccttcccttccggcaagatggatttttgccagagttacgccaggcacgacaatcagcattgtaaccgattcgggagacatgatcgggccggttgtcttcgttgctttcgatcaggttcacgggatcgtatttgtaacacaggaaagctccgtcactccagcaggccaagctacaacattaattgatgtagacaaagtagaaagcgttacgttcttttcataacatccgatgaaagtgttgtatatccagtcgggatacggaggaatatattgttattttgatcgctgggctgaagaatgttttcggaacactcatacagagtatatgtctgcagatacacttgaagcagaaactttggtgaagatcgaaacgtttcagccggacttcgcactcttgatggttggagaccgcgttcctcacgactggctgacctggttaaagggtaagggtatccccgtatatgtttggctgaccgaagacccattttatatggatatcagcctacaggtaatcaagctcgctgacgccatattaacgattgaacaaaatgccgttctctattatcaagggctcggctaccagcacgtctattatgttccgataccagttaatcatcggctgtttaaaaaaatgggcaccgaacaatcctatcattcaaatctgttaatcatcggctacccttaccctaatcgggttcagcttatgaaagaagcggtccatctgccattcacggtccgggtaatcggcaaggaatggagaaaatatctgcctaaaaaagtgctcaaacagccgcatattgatgtcgtcagcacatgggttccacccgaacaggccgttcattattataatggggcagacatcgtaattaatgcgcatcgtccccatcattttgctttcaaccaaaatactatgcgcatcaaaaatgccagttttaataaccgaacgtttgatatcgctgcatgcgaagcatttcaattaacagatttacccgcggcgcatcctttttcatcctttatttcttatcacggcatgaacgactttaaggaaaaagccgctttctatatcaaccatcctgaagaacggcaaaaagctgcagcagccaattataaagagaccgtacccgcatttacgtttgatgagcttcctgcaaaactaaaagcgattcatctggcgctttcttgaaaaatcgttcattgctatgaacgatttttttattcatagaaaaaagcagctgcacaagctgctttctattctagccgtcagaacggtctttcagcttcctcggatttacctgtttatgaagatcaggcatttcgccgagatgctgtgcaatttgttcccacgatacaattttgaaattttgattgacggcttgtccgttatcgatattttcgccgtcctgcgccacaaaaatcccgtatggatattttgggccaagtccgaaaccgagaacatcaataccatccgtgtcactagtaccgtctattttctcgccatctgtaatctcaaagttggctacatagcgattttccccctgccgttcatacattgcatagctgttatttccttgacttgaagccatgagatatcctttgccatttggtgcataatagattgtcagtccttcaatatcagctgtcaaatgatctcctgtcgcacggtcaacaacctgcccctttgatcctccgccgggctcagcgttaaatttccagatggcctcatcttcctctgctatgtataggttcccatactcatcatccgcaacaaggccttcggtctgagaattcaacttaaattcacgcacctttttccctgttacataaccctttccaccatcaacaatttcatactgctcaaattccccttgtttgcctgtcactaatgcgtaaaatgctcctgttttctggctgtgatacaggccgaatccataaacctcagaaatattggtggaaataggatgtttcggatctgtaatgcttttcaattttcctttatccccgtctattgcatatacttcaattgtattttttccttcggaccggttggatgcagcagcaatatcaattttttcgccgttcaatggaaaatcatagcgcagatcgacattattgagcttgccaaactcataagaatgaagctgttttccgtctaaatcatacacaacgagccctgacttcttatttgttgtaatcaacttgcttttttccgggtgtttttcatgaacccaaatggccgggtcatctgctgcgtcatcgccagatgcgaccggatctgtctccgtgtgtgcagtcactttgaaatgatgttcctcattcacataatgagccgacaccgaggttgctgtcaggctaagcaataaacccgcggcagtgcttagcagcattgtttttgaaaccttcatttggtatcctcctcttttatcactatcactattattgtaaaatatatacaggtgattaccgtgaggaaaatgaacctttttttatagggtttctgactcataaacaacttattccccaaagaggtaagtgagatgactttgccagatttgcttttgcggagcgaaataaaaatatgttgaatatttagtacattgtttatttagttttgtagttccctagttacgtccgtttttccattttctattaaaaaagaacactttgtgacatgatcattcccctaaattttgttttattggttgctttcattaattcgattacaaagttgaacatatgatgcatggtagagaaacgagagttggaggataagccatgcctaaacagcaaacagcagaactaaaaccatttttccataacaaaacagttttagtcactggcggaacgggttcaatcgggagtcaaattgtcaaacgccttttgctgcttacacctaaacaggtgattgtattcagcaaagacgacagtaaacagtatgtcatgagccaaaagtatgcggaggataagcggctattatttgtactcggagatgtacgcgatcacagaagggtgaatcaggtgatgaaagacgtcgatatcgtctttcacgcggctgcgctgaaacaggttccgacatgtgaggaccatccatttgaagcgatccagaccaatctcatcggcggacaaaatgtggtggaagctgcccttacacaccgagtgcagcatgtcattaatatcagtacagataaagcagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttcgcatggacagcgttctccatcatcgccataaagttcagcaccgctttccgctggtggccgtctacgtgttcagccacgatcggcatccccgtattcccctgctctgtatcaagaagcgtaagtccggccagtaccttcatataagtgtcctgctcattttttccgaggtacttccatgtgaggagatcgccgtttaaagcaatctcttccggaagccagaactgtttcacgttttggttatagaacatttgggtaaaatcgtcttcatgctttgaccagtttgctgcgtcataaatttttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattctttctccatattcccctgaccaacacttcaacttctttaacctcaactgtttgctgcatcacatccctcctttttgtttttcgtgtatcaagcttgtacaatnnnnnnnnnnnnnnnnnnnnnnnnnnnnnnnnnnnnnnnnnnnnnnnnnnnnnnnnnnnnnatgacatcatcaagcaattcaacatagatcaattcttacctgaaggtgaatatcacccaaactataatgtcgctccttcacaaaacatcctgacaatcattaacgatggatccaataaccgtctgggcaagcttagatggggccttatccctccttgggctaaagatgaaaagatcggctacaatatgattaatgctcgtgccgacactggccgagaaaccaagctttcgaaagccacttgtcagcaaacgttgtatcatacccgctggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttgcgattagctttatcagaccattaatatcgttcatgcgtattatttgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttctttttgttctttctcaaatgtttgtatgtggttgccttcgaaccatacccttactcttattccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaatctcgattttaagttaactttaaagtaaatgtcttgataaattcccctttaattggtaatctggcacctaggatcatacaaagaaggtgataccttgaaaaaaataatcggaataattggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccgcttccattcaacataatcaaaccgcttctgatacaagtcttcaagtataacagccccttcaatccaaccttctgcaacaatgcttttcttttctccattttcaatccactctatccaatacacctgaacactcctaacgctttacgacttggatttcccttacctcacattgcacattgcactttgttttgagttcactggctacctcaatgacttcatacattgtttgcaatttagaagcgccgtggaggtcgctagatgttaaataaccgtcctcatctaacttaaatgatttgaagtattccttgttttcaaactgcagtacataaaaataatcaagcaaaggcataaatcaacctcttttaaataattttgtaatcctcattactaatggcagcaaaccaattaacatgaaaaaagcaataacattaagcttatctttgaaaaacaggctggccaaattcctttccatgcccgctgctgtttctttatccatgagttctttaaactcttcatcatagacctgatcaacaaaaataaacttaatgccagtcaataatccaactccaagccagattattaaaaaataacctaatccaatcatttgttccctccctatatcgaacgaaatttggtattcttgagtatgtgaataaattatgtaggtgatcttgtggaagagaaatacgaaactaatggatatgacacttcaatcgtttatgattacaaagagtatcctgatgtaaaatatggccgctgcgacaattgtgattacactttgttcaaaagctctgtgaagagtggaatattcttgcgtgaatgtcggcgatgcggtatgaaaaagagcatttagtttaatgcgctttttgtttaaaacacttcttttatcttgattctttatgctctcggattaagacgcgtaatcgtgttaaggttaattcatgaccgcataaggagtgataccttgctaaaagttgcaaaaatttcggtttcttgcattgcattagtcttgtgcgtatactcattgttcaatcaaaatgaattattgttgattgttgtgcaattatttgttgccgcccttttatcattagtcggagttgaagcgatattaagcaaacaaaaactgtccggatatttactgtttggatcagcagccttcttacttgttgtaaacggtgtgaaattcataatttaatttaatgtgttaatttcgtaggaatatggagtcccaaaaccaataaataagacctgcaacaatactcataatgtaataatttaagcttctgaatacagtaagagcatttggcggataatcaacagtccagaacaaaaacacagctaggctactgcaatataaattaaaaaattgttcaaactgaattttctgggccttcttctaagccacacttgcaaagggacagcaaataccaagtaagtgattaaagcataaactcctatgatgccaatagtgactaatgcgaatgccataaaaccagagtaagcaaacatatacagaccaaagattaaaccaaatgataaactagagataattagagtataaacataactgtttaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttttggataaaagtacgattttatttagacctagaaaacttgtaattctttcctaaccttataactttagtataccattttcatcctgagtattcgatatggttctgactttttggaatatcaacaactcatgcagttcgatgttttgatagggacagactttatcaaacagctctctcggataccgctccatttcgtcattatatagctttctgacagttggatactcatgatcaatatctctggaaagtttccggatactgatctttctttggtctataatcgtttttaactttgatttaatcatattctcaccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacaaaagtgcccatagcacctctatttccacaccctccccaaatttacattttcctaatatcgcataaaatcgtcctttttcacatcgtaatcgctatcgtaaaagcctatattatcaacgtttttccttctgaaaattttccctttctcatcaatatctccttaaaacaacccctttcccctactcctgcttatgttttacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcatactgataccaactatcagtcattgctcctttttcgtataaatcatatttataatacgcatcagggatttgttcttttgcccaataagagaataaaatagtggcagccttactcccccatcccaagccagggacaataccgactaatgacattgtaactgataacgcatttttagctgcttttgtatgcccagataaagtccccacataatggtatccctttttaggttttgcagcctgtgttgtgaattcatttgattnnnnnnnnnnnnnnnnnnnnnnnnnnnnnnnnnnnnnattttcatcatactcaaagtttaaacctttttgttctatgccatcgacttttacagtatgatcatttccgttcatctgaactttgtgagtttcatttccactcacatactcaatttcaactaatttcccgttcgatgaaatcttttcacttttcattttgtaatgtagagctagttcttcgtaagaaggggttgtcttagagtcctcctttgcannnnnnnnnnctgcaggtaaaagtgagcctaaagtcaatgatgcagccataacacaagtaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaactccagtgccataatcagtttttgcaactagaaaaagacttaacacaccgaaaataatgtacattacaatatcaaagatatttttcttgttgttcatataaactcccccgtttagcaattgattccaggtgcatatttgattgcagccccagtgtattaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttcattaaaatccttttcgtgtttgttgataatatggagaggtgatgaaaatgttcaaaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcaatttgaacgagttttcaaagtttattaacagcaatatggagtctatcggtaagagtatttcaaacaaccttattgataagctaaaagaggcttcaaatgcactctccgcagtagtaaggggaacacaaccgttaaaaaagtatcgtcatttgatacaggtggatacacaggaacaggcttaggtgctggcaagcttgcattcctgcatgacaaagaactgatcttaaataagacagatacagagaacatgcttcaagctgtaaaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatggaaatggatattacacagtatttaatcactcaggggccttttgctgtgttgttttgctggctcctattctatgtcatgaaaacgagtaaagaaagggaagcaaagctctataatcaaattgattcccaaaatgaagttttggggaagttcagtgaaaaatatgatgttgtaattgaaaagctagacaaaattgaaagcaaagtacaataggaggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgccctcctgttagcccagctctgtgaagtgctgtccctgctggtgtataagaaactgctcttagaatcgctttcgatccgtatttgtttctaattccatccatcacaaacccgagtctccttctcttttcattatttacttcaaataaacttaactgctgattaacatcatcctcaatattcgttaacgtaactgagatacttcgcaccgtcttccccgagtaaaacttattaaagagcatcaagcaacatctatatatgtccatcgtgatatttgtgggaagatctattgttttggctcggtgaaaatccaccaccaagatcatctttactgtatcaaatacccaggctgattgttcgaccagctttgttgtgtgtacgtgcccttcttgcgacttcctcgcaaatttccaaaagaacagccttaatctcttctctccttatataatccctcagtaaaatctgactcttaccaaaactaatctgcccttgcatcaaaggagctcctatttctgataaatcgattccatgagcatgataatacaactggtttcccattattccgaacttcttttcaagcagctctaaaggaannnnnnnnnnnnnnnnnnnnnnnnnnnnnnnnnnnngattcagatttctttccatcctccctcctatcccccacattttagacaacgggtgaaccttccagagtttatttggcacatcttcatatctccaacgtgcaatgccacttttcgttttcttactctccaggtcaagtgcaagcttactaagcaacatattgtcaccaattccaactgtacagatcaggccaaactctctccgcatactactttgaattgctttggccatttcttcaggattttcttttcctgcatctaaaaaagattcatcaattgaatacgtatggacacatttttcaggaacaaatctgtaaaacagctttgtaatctcagttgaaactctgatgaaaagcttcatttgtggatttacaatgtgtattcttggatcttcaggtatctcgaacaatctcgatcctgttttgattccaaaatcttttttaagtgcaggagatgcagctaacactacacttccctgtctctccgtatttcctacaactgcaaggtagcatgttaaagggttaagccccattgttacagccgatacagaagcataaaacgatttcatatcgacacaaagtatattctttcgtggaaattgtgagtaatcaatcattgtatgtaactcctatgatgttattcatgttgatataaactgtattgtcgttctggtcttttacgtgaagcttttgttgttcaaaatttatgtaatggactctgccggtgacattttcaacgaatccattatgaaaaagtttaaatttcaactctttattaaattcaagtgcctcagagacgagaagatccatctcttcaatttgttgatcatccaaagatggcttttcaatttttgatacatcaatcaaatcttgtttaagctgtgttaaatgttctgggagcatcattgatgtccagtcgattgttcctcaatctctaagcatatcctcctttattgatctaatattaacagaacaaatgttnnnnnnnnnnnnnnnnnnnnnnnnnnnnnnnnnnnnnnnnnnnnnnnnnnnnnnnnnnnnnnnnnnnnnnnnnnnnnnnntattaataaaggagagattcttttcgacgagggagacggtgatggtaaatgaagaagaggttaattgaatttttgattttagttcctgttttgattatgtcaggtataactttaaccgaagcaaataaaaagtcccctttggaagtaatcggtagtattcgggatgaatttggtttatttagtgtgcaaattggtcaaacagatccggcaattacaattgcatggatcataccaaaagtgaagcaaagnnnnnnnnnnnnnnnnnnnnnnnnnnnnnnagtgaagcaaaggaaaaatataaaatttatatattcaaagatgatattgtaaattggagaaagaacataaaaagtatttgcgagaaaataactctaataagtaaaacgcccagcactttattaagctgggctctgtctcatatttaaattgaatttttatacgcattaactgcttcgtttcgcaacagcatattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgcaaaacttttgctttatggataaaaccattattttattggaatccagtactttatcgatgcacaagtgatattatccatgattcagttcaaattcttctcttgtcattccaaagcaaaaaccatcataataagcacctttagtgaaaatgatctttcttagttgtccctctttcatgaaacctaatttttcatgtaatcgtatggatggattattaaaagaataaacagttgtatttactttttgataagcaagttccaaaaagaaaaagcgaagaaccatcaagatcatttctttggcaaatccttttcccctatatggctcgaatacagccaaataataaccgaaggtactatttttcctatcacagtcaaaggtttcaattatacctactatattatttatcactatcaactgcaataaaacggaattcatctttttctaattgttcttctacccattctctcatgttattagctgaacgaggaaaatgtagcaagtccatatttcgcagaatttcatcatctaacgaatcaaatataacgatatcttcaggttgaattgctcgcagtgtaagattctcccctgtccaataactaactgccattttaacttttcctccagttatttccatacgctttcttaactgcttagtaagtcatcatctaattcaatatacagaattccatcatcttctttatcagcttcaattggttcatcaactaaactgaagacaaactcctcaaacgaattggcaattaagaaaaagtctttgtcggggtgacttaattcatgatcccaaaacaatatctttccattatcgatatccatgcatatttcattcccgcctgcagagcttgcgataggaataatatttctaggaaagcgatcagaatatgtatcgattgctttctgaagactgtcatgatcgttcgctaaaccataaaaaccttctaacaattgtgtattatcgcccttgcccatccaaggatctttctctataggtttatagcaaacgtcatactcaatctcatctgatgtttttttactttctaaataacagccgccatattccttcaaaaagtccttataatcagaaggtaattgttttcctatgttcatttcaatttctttgagttgttcatttttattgattctgggatctgtttttgcatcaattaaaaactctttcaacttttgtttgacattattgaagctcatattaatcccctccgcattgcacatctttagcaatgaacaattgcaatacttttgtttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaccacattgtatggcacattatcggctagaggaaagtcgtacttaggattataaggcagcaaatctggaatcttgacgtccttaattttcttccctgcctgacttgctttgtttatgaccttgcccgctgcatctgctttgttaatggctcctgcacctttggttccaaaaacagctacagccactgaaccaacagcatacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttcaatttgcactgcaagctgcacttgagctggctccagattctcgtaccctactttcttagcaacttttagatactcgtcaggatcatcaaccaacgtattgagctttttctgtaattctttgatttcccaatctttttcttctttcttcttaatcatcaaataagcttcagaatgcttctctatgtcgccttttttcttatgtatgtcactttctctatacgctttggcgttatagtgaatcggagtggcgttcttccctttgcctgttgattcctgcagctttttaaaatcttgctggatgaactgttcgttaggctctgtttcagcgtattctgtttttaaatcctcatcaagcttgtttattttatcaatcgttttttcacgtttcttatctgcactggcaagttcatctttaaaagtctctgttgaaaataaatcaagtgtaagaatgtcatcgatatcattcagaatatctttcattgctttcttctgctcagacataattgattttgattttttatatgcgtttgttagttcatgttctaagaaggattcctcgatatatgcgtcagataagctggcttcctctacaactccagagatacttgttaaggaaagcaattttcatatcgataaggtcaatccattgatctgtaacacctacatggtcatgataaaatgctttgatgttgtctgctcccttacctgaaaactcgctgtcatctaggtttgctacgtctttaaatgcttttctgagcttaatcatttgtgatctgagttccttgtactcttttgcacgtttatccgcttcagaaagtaatgactttgcttcaaataccttcatatcattctcctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatgcagtgtcatgaacttctgataatcttctggaagggtaatctgatgtttagcttcaaggctttgaatgtcattcagggttgctttgtcctgtgaaaatgtaacaaggaactccatgatatcccctttagaacaaaacaattgaatggctccttttttatccaaaagacttttcaagccatttaccgtcttatgaacaaagttagtcacatacatcacccctatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaagctgcaattagagtttgataaagttgatcacagataattatagaagactgttagccgtgcgttttggttaatgacaagtctggtcttgaaacataattgaaagaaggattggccagagtggcttatgttatgagccaaacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagataaagcagtatctcctgtgaacacaatgggtgccaccaagctgttatctgaaaagctgtttcatcaagcaaaccgccacgtccaaaacaaaggaaccttgttttgttcggtccgctttggaaatgttctcggttccagaggttcggtcatccccatattatttgaacagatgatggagggtgaacctctgaccatcacagacaaaaacatgaccagatttttcatgtcaatagacgatgcagctacattgacattacaatcggctgctattacaaaaggcggagaaacctttattttcaaaatggaatcactgaaacttgaagaactgattcatgggtttgaagaatatgcatcgcagcacgggctcccgcggccggctgcagtagaagtgggcaagcgtccaggtgaaaagcttcacgaagaattaacatctccacatgaaattgaatcactgtatgaatggggcaacctttatgcgatccttccagagccggaaaaacatcctgactttcgcaaagtcaatctgcctgggtatcaatcagatcaagccccgctcattacgaaagaaagaattgctcagattattgaagaattgcatcaagagaaaaaggcataaaaacaagcctgtctatccattaggcaggcctgtttttaacactttatttattaaagagatgcagatagctttcgtatccttcttcttttagcttatgcttcggaacaaaccgcagcgctgctgaatttatgcaataacgaagtccgtttggaccaggtccgtcattaaatacgtggccaagatgagaatcagcagttcggcttcttacttctgtgcgaatcatgccgtggctcgtgtccagtttttcttccacttcttcctcttcaatcggctttgtaaagcttggccagccgcagtgggaatcaaatttatccttggatgtaaacaatggcttgcctgacacaatgtctacatacaacccttcttccttatgatcccaatattcattttgaaatggcggctccgtgccgttattttgcgttacttcatattgcatgcgatttaatgactttattttttcttctttattgtacgccatttatttagccccccaatgctcactgataaaccccgcacgtccggaacctgtccggtagcgctgataatgtgctggattctttttataaaaatgctgatggtagccttccgcttcatagaaaggttcagcttttaaaatgtccgttacaatcggatctttaaagatgccgctttcagccagacgttgcttggaagcttccgcaagctccttttgtttatcattatgataaaaaatggctgcgcgataggaactgccgcgatcagcaaattgccccccggcatctgtcggatcgatttgctgccaaaataattcaagcagtttttcataagggaatacatcaggattaaacgtgatttgaacggcttcacgatgtcccgtcgtttcactgcacacctcttcatacgtagggttttcagtatggccgcctgtatacccggacaccactttttcaattcccggctgttcgtcaaaaggtttaaccatacaccaaaaacagcctcctgcaaatgtggcgatttcttttttttcagacatactggtgcctcctttgttaatacgtggtattattatattatagcatgtaaaaatagaatgaaaatgattctgcttttcaataaaatctataggttttaagcaatatgcttatgtaatggaggttcacaaatttgaaagtaagaacacagatgatgtacgatatggaaactttactccgtaaagtctttaaacaaatacgcaatgaaatcaatgaaattttagataaagagctgtcgcggaatgaattcaccattcttcggatcctcagtgaacaagggcctaaaaaagtcactgaatttgcgcctattttagaggtatcggcaagccacattacggctgtgaccgatgcgctggtagaaaaggaatggattacgagaatcagatcgaaggaagacagacgcatcatccgcattcatatcactgaagcgggcgaaaaagtccttcagcactttaacgagaaaaaaacggaatatttctttaaacgctttgactgctacactgatgctgaacttgccacgttaatcgagctcttcagcaaacttgataaaaaacggtgaaaaaaagcacataccgatatataggtatgtgcttttcgcagtgcttcacttatttttcagtaaacagcttcattgctttccagcggccatatctataatacaaaaatgccgcgcagctgctaaataaaaaactcattccgattccaagcccgattcctttttgtccaagccaagctgaaaatagagctgtgaaaggatatctcaacacccaaaacgagatcaaatttaataccagaacctgcagcatcgctcccgcggccctgacgattccgttcagcacaaaattaatcccaataaaagggtagaaaaacgcgatccacttcaaatattgttcaccaaatgcgaccgcatcaggctcactgataaataaccttatgagatatttaccaaatacccaaatcataaccgcaatcaccagcatgcaggaaataacagccaccacacctagccttgcaattgttcccactcttttttcgtttccgattccaatattttgccctgccatactgttgacggccgtaccggcagccattgctggaagcgtgatgatactatcaagccgctgcaccgcgccaaagcctgataccacgtgatccccgtatgagttaacaacactcataatcgccatcataccgcctgtaatcaccatcatctgcagacctgccggaatcccgagtttcaaaatcagcgcggactcttcccacttgggcattctcggaattgagaatggcacaagcttgtgtttgaccacataaaacaacccatacaaaaacgcaatgccctgtgacaaaatcgttgaataagccgctcccgctattcccatgcggaacacagaaataaagagcggcgcaagcactgtattcagtacaacagcaaacgcaataaaccggagaggtgtcttgctgtcgcccagcgcacgaagcacagtactgataaagttataaccaaacaaaaataaaatgccgataaattgaatctgtaaatacgtctcagcaagcggtatcattgactccggcgtttttagaagacgcagcaaaagctctgagagaaaaaaaccggccgcgccgaatccgatgcttaggcctgttaataaaacaacaaaagcgttaatatacgacgccattccttttacatcatcttttcctttttgctgagataaaatggttaacgtcgcattgttaaggcccaaaataaaagacagcacggtcaaaacaatcgtgcttgataccgcggctgccccaagggcctttgcccccagtaaattgccgatccacaagctgtctataaattgaaaggaaacctgcaatgcgtttccaagcataataggcattgaaaacagtacaagctgtttcagcacgttcccctgtgtaaaatcgtatgctttcatcttttctccttgtgttctcaaattttcttcggaccgcacgaaaaaagagacgttgtttcatgtctcttttttcatgacttatcgggtttttttcggtctcgcataccgaatgtaaacaccatcacactcaggaacaaggcacaataggaaacattcaaatacatttgatccatatcttcagcagccagatgatgataagcaagccagccgaagtacagggaaaatgtaaaggataataaactgaaatactggtaaatccgtttcattttcagtcacctctattgtttaggatggtaataggaaaactcaatttcatctttttctaaatttatcttatccgctttgacatacattccattcgttaaaggcatttctgacaaacgcacttcaatgcttttttctccggggtgaacatggacaaatgacggcaattcataaaagctgtccatataatttaacacaaagctaattggtatactcaatttccctaacgaaaatttcgtgacattcagctctacatcaccgttttttttcacagtcggctcaaaagcgataaacgcatcaatagacgtggaaaatgccttgattttccctgcgacatgaacatcatcatcaatctctactttataatcaagcttgtttgatgctttgtcgtttaaatatgagttaacaaacgcagctaatgattcttttgtgcttgtcacttgaaatccatactcgctctcagatgcatctttcacctgagcctgttcccccggaagcaaaacaagtgccacaaacccggcggcgaggataaaattgattgcaagcaatataaaaaacagtcgcttccacttattcatgctgtcaccctactctttcggtaatccttcttttttaatggcttgatagacgcgctttgcgataagagaataacccgtaccattaggatgaaaatcatcttcctcagaaattcggctgctgtcacttttttgattaaacaaatcttcgatatggacgatttttgcatgtttatcttttttcagctctttttcagcaatatggttccaatccgtgacgacaccatttatttcatttagttctgataatgtaaacgtaaacggattgtacatgctgacataaatcagctcagcgtgatcattcagctcgcgaatttcagaaatgattttttcaaagcgcttttcgtacggtttttccgcttcctgaaacggttcaacggttaattgcagaaagttttggcgaaggattttcatcaaatcattaccgccaattgtaaaaaagacataatctgcgtcctttatgcctttttgaacctttttatcttttagtttttctaataaatcatccgaacggttcccttttacagcataatttttcacgtcgaccgttttgacttgtttatctgaccggatagaatccgccaccttgccgacatatccctttccgtcgggatctccgactccttctgtcagcgaatctccgacagccgctatgacaatgtgttcttttgttttcgtttcatgggctttttgttttccctcagatgatgtacgtatgctcgtacacgcagtaagaagcaaaatcaaactggccatgattgaaaaaatgcgcagcttcaatcttgttgctccttcccattctactagtggaaagtgtatcatgttttagaagatttgcaaatgcctagtctcttagcttacttgagtgtactggctgacttcacatcggaaatgatatcatcgtacggtgtattctccactccattgtaatctttcagcaccttaccgtccggacctaccaaataaaaagaagattgatgaatcacttggtcctctccctccggcttctttacgatcgctttaaagctcttaagtgcgaactcctcaatctcactctggctgtatcccgtgagaaaatcccagttatcaaaagataatggataatttgcggcaaatttcttcagctgtttcggcttatcgttttctggatcaacactaaatgatatgatgcggacatctatattttcggctttcagttttttttgcagatcggtcatatgagcggtcattggcggacatatagtttcacaattggtaaaaataaaatccgccagccatacttctccttttaaactctctaaagaaacgttcttgccgtcttggttttgaaatgtaaaaggctccacctcgtaattgagcggatctttaatctgctgtcctccgcatgcacacaaaaacagaaaaatcagcccagccgttaaccccttgataaccttcatgacatccatcctttccagccagcataaaaacgctttctaaaaccgtccttactgtcccatgtttgtattcgatactgagcaaaaaaaatcctgcatgcctccccattaacgattacaaaggagggcatgcaggtaaaaaacggcatgttacgcgttgtgctttaacacctcttgatgaaatacagcctgataatctgcccacttcatccgccgcttcatataatgtcggaaagaatacacttttgccctgctgtttgatgaaaacacttcttttaagtagaattgcaaatggtgatgtaacataaagaaatagtgctcatcttcctttaatacaggtatttctgtcactttcacctgaatcccgtcaccgcgtttgaactctaggcttttgagtaacaagctatcaatcctcttttttgtttttcttctattatatatgatgccagccgggctgtctgtcattttgcgcggttgtgtaaaaaaattagattagcaaatggaacaagtcctcatccttgttcacctctacataatgaaacggttttttgttcatccgttcaatcagcggcccataatcggctttgttctgcagctcgatgccgacaagagcaggtccattgcttttattatttttcttcgtatattcaaaccttgtaatgtcatcattcggcccgaggacttcgtcaagaaattcgcggagcgcccccgctctttgtggaaaattgacgataaaataatgctgaaggccttcaaaaatcaaggaacgctccttcatttcctgcattcttccgatatcgttattgcccccgcttaccacacacaccacgtttttccctttaatttgatccttgtacaaatcaagcgctgcgacagaaagagctccagccggttcagcaacaaccgcacattcgttatataattcaagaatggatgtacatacttttccttcaggcacaaggagaatgtcatcaacgacagtttccagcgtccggaaggtttcctcgccaatttttttaacagccgccccatctacaaacttatcaattttatcaagtgtgacgacatgcccagctttgtttgattcaaagtaggatgccgctcccgccggctcaacagcaattacctttgtatcaggagacacgtttttcaaatatgtacctaccccagagagaaggccgccgcctccgacacttgcaaaaagaaaatgcggttctgtatcaatgtcgtttaaaatctcgactgcgagcgttccctgtccggccatcacatccggatcatcgaacggatggataaacgtccgagattccgcctcacagcattcagcagcgcttttatacgcgtcgtcaaacgtatcgcctgtcaaaataatatcgataaatccttttccgaatagttcaacttgagatactttttgtctcggtgtagtagacggcataaaaattttcccgtgaatgccaagatgtttacacgaaaatgccacaccttgagcgtggtttccggcacttgcacacacaactccgttctctgtctgctcgctggaaagctgtttcattttatgataagcccctctgagcttaaaagatctgacaacttgcaagtcttcgcgttttaaatagatattgcattcatatctctcagaaagtctgtcattcctctgcaaaggtgtgtgaatgacaacgtcctttacgttttggtgagccttcaaaatgtctttcacttggatgagagagttttctttaagcaacggtttcatgtacagattcctttcttgttttaaatccctatttaatatgccattataacatgaatattcaaaaaataagacaattatttttatttaataattaaaaaaatacagactatgtccaccacatcttgtggtaacttctgttcaaccattatcctgcagagccaagaaaaaagatgatcgtaaaataaagggtgttttcaaccaaaaggcatgatataatgaaaccaattagaaccaaaaggagccaattgatgaatagtgcaccaaaactcaatacatttcaacatctaatcggagaacatcaaacttttctggaagcgaagcgaatcgccaagcagttctcgttatcggagcttcctgtcttaataacaggaaaaatcggaacaggcaaaaatcacttcgcacatgccatacacttggaatcttcgagaagcaatgaaccgtttataagcgtcaattgcagcacccattcggaagaaacccttattcatgagctttttggccctaacggaaacacaggtgtttttcaaaaagcggtacgaggaaccctttttcttgatgatgtatggcgcatgcctgcttctgtacaagctcagctgttaaaagcgcttgattcagacacggagaaaccgcgaatgatctgtgcttctgcagaccgatccgtggaacatacattcaggcaagacttattctacagactgaacattttaacgctcacactgcccgaattatcggaacgaaaaagcgatattccgcttttgacacagcattttctctcaaattctggtcagcaattgttaatcgatccctccgtttttcccgtgcttgagaagcatgcatttgaaggcaatgtcagggaattaaaaaacgctgcagattatatggcggcagtatcaagcgggggaacgattcagccatatgacctgccgccgtatattagaggcacgatagacggaaaaacgtcgaagaaaaaagcgaaactgcttactttaatggaaaaagctgagtttttgtttattttggaaacaataaaagtattgaacgaaaaaggagaacctgccagcagacggatcatttctgaacacagcaaaaatacccaaacctcgttaactcctcagcaggtcagaagccgtctcgactatttggagaaaaaagattatgtcaccaaaagccgcggacgcgcaggcacaaaaattacctttgagggcttgagctttatagagacgttaaaaaatcaaatgatctagcgatcgaaaggagaatgtacttgtttacaatcaaagaagagatcgccaatgcgattacacacggcatcggtgtcctcttatccatcccagcattagtgtttctaatcatatttgcggctaattacgggtctgcatgggacattgtcagctttacaatattcggtgtctctatgctgctgttatatttgagctccaccctgcttcacagcatcacacataaaaaaacgaaggacattttggagattattgatcatagcgcaatttacgtactcatcgccggaacctacacgccttttttgcttgggccgctgaaaggcacactcggctttaccctgttggttatcgtatggtcacttgccctaggcggaatcgtttttaaaattttctttgtgaaacggtttatcctattgtcaaccttcgtgtatttagtcatggggtggctgatgattattgcagttaaacctttatatgcttcactgagcggagcgggattcagcctcctttttctcggcggcattttatactctgtcggaaccatcttttacatttggaaaaagatccccttccatcacgccatttggcacagctttgtattgggcgggagcgctgccatgtttttctgcgtgctcttctattgtgtaaaggtgcctttcctttcgtaacagtaacagaaaagcgcagtcttcacgactgcgcttttttatgcacgtaattgtttttcattggcaggtatataagcttttgaaaaggacaattcaatgtctgccggttttaagcgtttaaaaaacgagccattttgcatgttatctgttcctttcgtttccaccatcaccaacggaagatgatagcgggccgcaagttctacaggatcaatagaaccatctagtgaaagaatcaggctttgtcccttttccagctgttttgtcacatcttcatataccttttctgaatccccgtctgaaatcacatccatccgatccagccattgcccgataaaaggcaagcggaacacttttgggttagcgataaagccggccggttcctcaatatatccagcaattaaggccagttcagccaaacgcaaacggggatgcacatacaaaacaggaccgtgtggtattggctctggctgatggatcgtcacaactgaaccggagatgccgatacagccttctaaaaacgcctttggctgttcgtacacaagagccatctgttttttgtatgacagacggggatcgagcattgtttgattaaataattgtttcatattttttaacagcatatacacaatataaaccactagaaggctgtagcgaaccaattaaaatcctcccgctttagaagaattctttttttcatacattagaaattcgtaatcatacgggtttttttcgtctttggtcccctgctcagaagaaaccagcttccaattggattcatcaaattcaggaaagtgacggtcaccctcaaactcgtgatgaattttcgtcatatacagtctgtccgcataagggaacaggtccgtatagagctgagcccctccgatcacaaagcattcttcagggcctgaacaaatgtccagtacatcctttaatgaactgacaaccgtgcatccctgaaattctgaatccggcgctgaggtaacgacaatatttttccgatttggaagcggacgtccgatcgattcaaatgtttttcggcccataatgattgaatggcccgatgttactttcttaaagtatgcaagatcattgggcaaatgccacggcaaatcattgtctttgccgataagcctgttggcatccatcgcaaaaatgaatgaaatcatacgcttaccgccccttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctctaaaacatgtctacataaatccttaaactgtttcatttttttcatcctttaaaagtagtcttctagtagtgtaacacaataaaaaatcatttctgaacccagaaatgatttttttatagtcagctgacgacaggcttttcatcctgttctttttcttcatcttgcagatcctgatgcgtatgtgcaattctgctcgccgctgctgcagcaagagctgccacaatatcatccaaaaaggtgtgaataccgtctggactttcatcaagttccttaataattccaatcttctctttatccaaataaccgaaattggtcaaaccgatcgacccgtacacattaacgattgaaagcgggataatttcatctatgccgtaaagcggttcatccgtttcaacaaggtgctgcagcggttcggggagaagtttctgttctgcaagctgatcgagtgcaaggcctgtcaaaacagcatgaataatttcacgtttgttcaggactttttctacattctccatgcaaacactgagcggcagatttggattgtatttttcctgaagtttttgaacaatccgtgcaatatcttctatcataacgccccgtttgttcagcatatcctttgttatatcgaccatttcattcattgtgtactttttcatgtctaatggcatctcctttaggcactcatccagttgggaggcgtgttgcggtcccaataaatgctcccaagctcatgatgtgattgaaatccatcttctgctgtatgataatgaaaattaaaccagtagccgtcatgaggcgggtggtctcttcgcacatggaatctgagaagatcttctccagttgtccgattgtaaacgttgaaaattttttccgttttgcccgctgaaggcatgcttgagatcacaacatcttggtacgcctcatcatcttgcaatgtcgctaaataatcactaatcacattttcgatttttggcaggatctctttccgatagtcatcctcaatgacaggagcgattctgctgccgaattttaaaaaggactgatcctcagcgctgtcaaggagctgttccttgtacgattgaaaaagcagttcaggattttgcctgtcatccgactcatcatcgtacaggtcatgctcatcataaaaagcggtgtaatcattctgctcaagactgctcggctgtccggaaggcttgtccgccataagggcagccggaggagatacgagcccgaacgttacaatggtaaataaaaccacaagggtctttctcatccacaatttcataactgcttattcctctctattttattgtcatgtttctcttattttagcacatccaaaacatgcaagtcatgtactatatgaaactgatatgcaaattaggagattcgttgctatgcactttgtgtaaaaacgcttacaatatttcatgaaaggaggctttccgcatgattgacgctctgtttgccacagtttcactcttaacattattatactttgtcgtcatggaggtcaccgattaacagaaagcccgtgatatgaatcacgggcttgtttgaatgacgccataatggaacagtgctgtttttcttttcatgacgttaaaaccaaactgttcgaaccgcgggcttttccagtggtcttttagcacaacgctttttctggcgactcgtaccgcttcattgatacatccttcgtgcaaaacgggatcctctgccaaatcacgtaaaggcgcgatgccgtcagaggtttctacaggttcatgaaacattggatcgaaataaaccacatcaacagagttgtcaggaagctgcttgatgtgttcaaagcaatcaccattcttcacctggattcttctcatcgcagcttgaagctcttctatacccgtttcccatgaatgcagccccgtcctcactaaaacagacacaagatggtttttttcaatcccaacaacagaacccgtttcgcctactgccatacttgcgataatggcatctgaccccagcccgagtgtgcaatctaaaaacgtatccccttcagataagccggcagcccgaagcataggctcttgctctccctgtaaaaagcgtttggctctgaacatcgctgtattcggatgaaaaaagaatttggcaccttgtttcgtatacagctcaaaccgctctttgccgaccacaagcaaatcacgttcagctgatttcagcaggtgttcaaccgtttgtttattccggccgcagtatggcatatttagctctttagaaagctgctttgcagtttttatggtgtgttcagacggtctatagcttgttgttatcatcttctatactcccaaaaagaaaatgcccggaaaacgggcatttagcagtgcgcatcgaaggcagcagtcagatttttcatgatttcttccatatcgtgtccttcaatttcatgacgcggaataaaatgtacgacttctttgcctttcaaaagagccattgatggtgaagaaggctcctggccagtaaaatactcacgcattttcgcagtagcttctttatcttggcccgcaaatacagtcaccgtattgtcaggtgttttgtcattctggaggactgcctgtgtagccgcaggacgcgcaaggcctgccgcgcagccgcatacagagttaacgactacaagagttgtgccctctgccttttccataaagttttctacttcttccgctgttgttaactcttcaaaacctgctccagtcagctcgcggcgcatcggtacgacaagctggcgcatgtattcttcataagccattgacataaaaaaagccccctctagtatccttcatctgaagtaaaggatactatagagagggccggatttcaaatgttcacgccttaaaataaaagaaagtgtccccagctatctagattttcataataccgccggtgttggcacttgtcacaagtttagaataacgtgccaggtagccggttttcactttcggttcaaaacctttccagttcgcttttcgtttttcccactcttcttctggcacttgtacatccaagatgcgtttttcaatatcaacgataatatggtctccgttttcaacaaaggcaagcggcccgccctcagcggcctcaggtgatacgtggccgattgagaggccacgggaggctccggaaaaacgtccgtccgtaattaatgccacttttggtccgagtcccattccaacgatttgggatgttggcgccagcatttccggcatgccaggtccgccttttggcccttcgtatctgataatgacaacgtcgccttcttttacttttcggttgataatgccgtcaagcgcctcgtcctgagaatcgaatacgacagccggcccttcgtgtcttgtaatcccattctgtacgccgcctgttttaatgatagcgccgtccggagctagattaccgaataaaacagcaaggcctcccttttcagtgaatggttgatccagcgggtgaatgacgtcataatcctttacttcatgtccggcaatggtttctccaagagtttttcctgtaacagtcagcgcatctaaatgaagcgctccttctttcttggaaagctcattcagagccgctgacacgccgcccgcttcatgaagatcttcaataaacacatccgatgcaggcgccagcttggccaagtgcggcacgcgctcagcgacttcgttaatgcgttctaaagagtattcaacgccggcttcgtttgcaagggcaagggtatgaagaacggtatttgtagaacctccgagcgccatatcgagtgcaaacgcgttatcaatcgcttttactgtaacgatatcacgcggtttgatatctttgcgaatcgtttccattaattgcgcagccgattttctcacaaactctttgcgttcgggagatgtcgccagaatggttccattacccggcaaagcaagaccaagtgcttctgacagacagttcattgagttcgccgtaaacatgcctgagcaagacccgcacgttgggcatccgaactgctctagttcttgaagctcgttttcgttgattttccctgcttggtaggcgcctaccccttcgaatactgaggaaagagagatttttcgcccgtcacttgttcttcctgccgccatcggtccaccgctgacaaaaatcgtcggaatgttgatgcgcattgccgccataagcattcccggtgtgattttgtcgcagttcggaatacagaccattccgtcaaaccagtgtgcggatacaaccgtttccacagagtctgcgataatttcacggcttggcagcgaatatctcataccgatatgccccattgcgatgccatcatctaccccaatggtattaaattcaaacggcacgccccctgcttctctgattgcttcttttacgattttcccaaactcctgcaagtgaacatgaccgggaacgatatcaatgtatgaattacacaccgcaataaacggcttgccgaaatcctcttcttttactcctgctgcacgaagcaaactgcggtgcggagctctatcgattccttgtgtgatcatattactgcgtaattctgccatggtgatcctcctaaattctttcaattgtttgattggattttattttgacaattttcagtttatttatgagctgtttttgcaaataagataaattcaggccgccctcaccttgttttgttctttcgtgtttttatatttatatagctttctttcgatttgaaccctccaactattaatattgttacttactataaatagttttcggatatttttcaacaatattcgaaataatttttataaaaagtgaattcacataaaaaaggtgcatgatctgcaccttttttatctttattcgcctttttttctgctttccgtcatttgtttccaaacagaaccttttgcttcttctccatgctcaattcgttcaagcgccattttgacttggaggctgacctcaaattcgggatcatcttcggcagcgcgcaaagcttcaattgcactttcatcaccgacttcgtacaggaacatggccgcacgccagcgaacaagcttgctggagtcgcttaatgacttgatcatagcaggaatggcttgaggatcgccgatatcagacaggcagtctccggccgttcttctgactgatacagctttgtcctcaagtgctttatacaatagaggaagaacatcaggtgtttcaatcattcctaagtacacaacagcctgtcttctgatggacacttttggatcatccaatgccttctgtaaaaccgggatatcctcttctttcggatccatctgttccaagtgtgcataacgctttttccagtcctcatcatccagcatgtcaagcgttactttatacgctttgcgctgtacagcttgttttgcttcgccctttccttgagcggctgcttcagtcagtcgtttcagccgttcatcactgtatgccgcctgaagctcttctgtcacatcatggccgatttcatcaaagtcaccgaatctgacaccttgttctttccaagcccgctcaaacacaacattagaagcttcagatctaagttttaagatcgcctgctgaaagcgttcaggtaagccgaagcgttcttcccgctctccatcggttaatttaacttgcataggaatgccgctgaacatctgcacaaaaacttttacctctccaaaagattcttgatcagaacgattttcttctccgctttcagcactttccatcccaaatgcagtgcggacttgcggtaaaatgtctttccagtcgtatcttgcattccgttcaacagcaagaaaatctgcgacgtgatatacccctttaactccatctattttaaggatttccgctataacaggcggtgcgccttctgcttgctcaggtttatagttattgcttttgcccgccggaagctcttccgttaagatgactttcattgtattcgggcttggtgtaggttcaattgattttatcttcatgatcgtcctcctatagcatatctgtgacttattctatcatagtcgctccaagccttctattacgacgtttcggcatcaatcccgggtatgtctttttctaattggcggacaaattgaagcataaaattgtgtctttcttctgccagttcccgtgcagtgtctgtattcatcatatctttcagccgcagcagcttataaaaaaaatgagcgtaggcgctttgatcatctccataaaggccatgcccgtttgcgcccgcaaacatgaaagctctcgcaatcccgacagcaccaatcgcatcaagtctgtcagcatcctgtacggcttttccctcaattgagagcggctcctttgccagctttcccctgtctcgaaaggacatccttgttataatatgaatcaccctgtcagcattctcttttcctactccgaaaaaaacgagctgatcatatacttcgctcacagaaagcctgaccgtgtcaggcagcttcacatcaattaaatcatgaaccaaagccgccgtttcaacaatgaacaaatccgctttttccttttctccaatatacgctgcaagatctgctactcttgatacatgatgccagtcatgtccagagctttcgtcagtcaggatagattgaacccatgccctgatttgctctgcctgcttcaattccttcacaaaaacaccctctttttattgctctaatagcttcacgatatcgttttccagctctttcggatttgtatttggtgaataacggccaacgatttctccatttctatccactataaatttcgtgaaattccacttgatcgccttagttcccagcatccctttcgcatgttctgtcaaatacacaaacagcgggtgggcgtttttcccgtttacatccacttttgaaaacataggaaatgtaacaccgtaatttgtttcacaaaattcctgtatgtcagcctcttcgccaggctcttggttcatgaattgattgcaggggaaccctaagatctccagcccctcctgctgatatgtatcatataattcctgcagctgctttaattggggagtaaaaccgcacttacttgctgtattcacgatcatcaatacctttcccgcgaaaggctgaagtgtcatgtctttccctgtgattgtacgtaccttcatatgataaatagacatgtaagtccctcctatgtccttggtgctgattattttaccttttttaaatcgcaattcaaaatgtaaacatcaattaagaactcataagaaacctaacgatatgagcgtcagttcattatcaattcatatggctcgttttttatcttatcattctataaaacattacaattccctcttacatctttgaaaatcattttactgtgaaaccaaaaggcgtgtcagtgcgttttatttaaagagttttctgttgtttccccctcaacacgtatagatagattgaaaattggcgtgaaaattcctataatgaagaaaattaaacggggaaataatggaggtggcacgttgcctattaatataccaacacacctgccggcaaaacaggtgcttgaaagtgaacatatatttgtaatggatgaaagcagagcatttcatcaggatatccggccgcaaaaaattattatattaaatttgatgccgaaaaaaatccaaacagagactcagcttctcagattgcttggaaattcgcctttacaggttcatttcacatttttaatcccaagcacacacacgccgaaaaatactgcgagagaacaccttgacgaattttacacgactttttccaatatccgtcacaagaggtttgacggcatgattatcaccggtgcgccgatcgagcatttggcgtttgaagaggtttcatattgggaagagctcaaggaaatcatggagtggagcaaaacaaatgtcacttcaaccttgcatatttgctggggtgctcaagcaggtttgtattaccattacggtgtggaaaaaattcaaatgccgaaaaaaatcttcggtgtgttcgaacataccgttctttcaaaacacgaaagattggtaagaggttttgacgagctatactacgtgccgcattcccggcatacagatataaatatggaacagcttcaagcagtgcccgagttaaacattcttaccgcatcaaaggaagccggggtttgcttaattgtgtctaaagacgaaaaacaagtctttttgacagggcaccctgaatatgatacaaatacgcttcttcaagagtatgaaagagatttggaacgaaacctttctactgtcgaggcccctaaacattattttgcaaaaggcagcaacgagccagtgaatcgctggaaagcgcatgccacattattgtttatgaattggctgaattattacgtttaccaagaaactccttatgaatgggactaatttttctttttttagtgatacgctgagcaaaaaatatgataaaatacatctgattcagtctgcgtataacaaaaatttaaaatactggaatccaaatcatttaaaattagcttaactttttcactgcattaataattcgattatgtatttgtgttatgtttatgtatagacaataactccttacgatgcatgaagcttgcttgttgttgattacattgaggtgaatttacttgaataccaataaaagagtattaattttgactgcaaattacggaaatggacatgtgcaggtagccaaaacactttatgaacaatgtgtacggctcggctttcagcatgtaacagtttctaatttgtaccaagagtcaaatccgattgtttcagaggtaactcaatacctttatttaaaaagcttctcaatcgggaaacagttttatcgtttgttttattacggagttgacaaaatctataataaacgtaaattcaatatttactttaaaatgggtaataaaagattgggcgaacttgtcgatgaacatcagcccgatattattattaatacatttccgatgatcgtcgtgccggaatacagacgccgaactggaagagtcattcctaccttcaacgttatgactgatttttgtcttcataaaatttgggttcacgaaaacgtggataaatattatgtggcgacagattacgtgaaggaaaaactgctggagatcggcactcatccaagcaatgtaaaaatcacaggaattccaatcaggccgcaatttgaagaatccatgccggttggcccgatatataaaaagtacaatctttcaccaaacaaaaaagtgcttctgatcatggcaggtgcccacggtgtattaaagaacgtaaaagagctgtgcgaaaaccttgtcaaggatgaccaagtgcaagtggttgtcgtgtgcgggaaaaatacggctttaaaagaatctttgagtgcgcttgaagcggaaaatggtgacaaattaaaagttctgggctatgtggagcgcattgatgagctatttcggatcacagattgcatgattaccaagcccggcggcattactttgacagaagccacagccattggagtgcctgtcattctgtacaaacccgtgcctggccaggaaaaagaaaatgcaaacttctttgaagaccgcggagctgccatcgttgtgaaccgtcatgaagagattctcgagtcagtcacttcccttcttgcagatgaagataccttgcatcgcatgaagaaaaacattaaggaccttcatttagcaaactcctctgaagtgattttagaggatatcctgaaggaatcagaaatgatgaccgccaaacaaaaagccaaagtgctatcgtaatggcgtacttgagagcatacgaaaatcgtgtgctctttttatttatattcagccatcaataaaagcggttacatttttttatggaacttgcccttcttttgaaaaataagccgtttcgcaacttgacgggtgctcccagatggtgtatagttgaaccatcatttaacaatgaatcaaagttagatgatgacaaaattttttttagcacatgggtgctacagtactaggaggaattaagcaatatgcaaaacggtaaagtaaaatggttcaacaacgaaaaaggattcggcttcattgaagttgaaggcggagacgatgtatttgttcacttcacagctatcgaaggagatggatacaaatcattagaagaaggacaagaagtttcttttgaaattgtcgaaggtaatcgtggacctcaagcttctaatgttgtaaaactctaaactcaatacatgatgatgagatgacaaatagaggagaggcattcgcctctcctatttgattttcatctggatttcaatcgccaaaatgttttgtttgcacctctgttcaatctcttcaacatacttttccattgacggttttccttttttcgcgatatccgccagttcttctaaatcactgtatatttctataaatgttttgtgaaggatcaacttcaagtctttatcatccatagctgcgttccccttctctatcaagatacctcaaatagtaaaacagtcctatttattctggttcaatagttatatcggcttatttttattttcttttctattttagtacataaatttcaaaaaaactctgcaaaataatggcggaggtgtttttggtgacttcagaatttcataatgaggatcagactggctttacggataagcggcagctggaactagcggtggaaacagcgcagaaaacaacaggagctgcgacgagaggccaaagcaaaacattaattgactctgcataccaagccattgaggatgctagagaactgtcacaatctgaagagctggcagctctcgatgatcctgaatttgtaaagcagcaacagcagctgctagatgacagcgagcatcagctggatgaattcaaagaataaaaaccgcagcttctgcggtttttatttttagtgattggttaagacatctccgtattgtttcaacttttcaccaaccgtacatttattgatacaaaatgaatgcgcataagttttgccaaattctttgcgaaactgcttcttaataaaacagtccttgcaatattcatcgtgcagttctgtcagttctttaaagatcattttcttatccaatatcgtcatctccgttacggtctaatttcgtgtggctttctacgaattgatgggatagaatttttttagcgaggccgtcagcttcctgattgtcttttcgttgtattgtttcgtaggttggagtaagcttcagcgattcaaggagtgcttctattttgtccagccattcattatgagatggatcataacaaggccagctgccgtcaagctgattcagcacaacaagcgagtcccctttgattgtaattgaatttctgcttgcccccagctctcttacttctcttattgcttcataaagcgctgcgtattcagcttcattattggttttcagccggaagcttttattttttcttaagcgatgtcgggttcctcccaatgaataatagatgacgatcccgagaccggccagttcgctctctttatcgaaactgccgtcaaaataaacagtaatgtcatcaggctcttgagcaagctcctctgtcagcttttccaattccttcagcgtccagctgccgcctttctcgtcttcgaactctagctccttcatgtatggaaaacggccaagttctctggcgaacatacgtgcctgctgtgctgtcagccagtcttcgctaaaaaatgagacggatcccgttccttttgcttctattttcaaatgcggtctgagcttcattacaatcaccttaccattcattagttgccgggcatatgctataatcaaaccaatcttaccccggaaaggaagctttttcatcttgtttaataattcgttttggatcttttttgcgatcattcattttatcattgttcttttattttataaaggatttggcaaaatggggctgtttgtttggatcggttttgcgacagtctgcgccaacctccaagtcgtcaaaacagtggaactgtttggattaacagcgacactcgggaatgtgatgtatggcacaatcttttttgcgacagatgtgctgaatgaaaaatacggaccagctgaagccagaaaagcggtatggctcggattctcaacgctcctgacgctgacatttgtcatgcagggcgtgctgcttttcgaaccggcttccagcgacatatcacaaacagcgctggaaacgatcttcggattccttccgcgagttgcgttaggaagtctgcttgcctttatcttcagccaaacgctggatgtttatgtatattcggcaattagaaggatatttccttctgatcggcttttatggctcagaaacggcggcagtacagcagtcagccagctgtttgatacattcatattcactgcagtcgcctttctcggcatttatccggcaggcgtgtggcttcatatttttatttctacatatttgattaagtttgcggtatctttgatttcattgccttatgcttatgcagccaaaaaaatgatacctaaagatgaaaggagttcataatgcctacagaaatatacgtagacggcgcaagcgctggtaatcccggaccttccggtatcggcatttttatcaaacatgagggaacagcagaatccttctctattccaatcggagtgcatacaaatcaagaagcggaatttcttgcattaattgaagggatgaagctatgtgcaacgcgcgggtatcaatcggtttcctttcgaaccgattcagatattgtggaacgcgccactgagcttgaaatggttaaaaataaaacgtttcaaccgttcgtagaagaaatcatccgattaaaagcggcattccctctttttttcatcaaatggataccgggcaagcaaaaccaaaaagccgatcttctggcaaaagaagcgattcggctgaatgaaaagaattaaatcttgatcattggttcatcctaatggcgaggtgaactaacatgaaaaagaaagataaaggccggctgaccggcggtgttactccgcaaggcgacctggaaggcaatacacataatgaccctaaaacagagcttgaggagagagcaaaaaaaagcaatacaaaacgctagagaagatctaaacgatctctctagcgttcagcttttcaagcatacgctcaattcctttgatttggtggcggcgaagcatgtcagccgcctgctccatttgcaaagtaaataaagcgtctttcagtgtgcaggccagcggcactgagcaatgaatttccgccagcttcctcgacatctccaaatcgcttaaaccttgctgaatttttccctgctgtccttttggaagaagagaaagattttccaataaacggtcaatcgtttcatattcacgaatcagtttgtaggctgttttttctccaatgcctttgactccgggatagttatcactggaatcacccataagcgctttaatatcaatcaaagccttcggcattacgcctgtttcttcataaaaagtctcttttgtatagactttataatttccgattcctttttgaagcaaagcaacgcttactttatccgttaacagctgaagtaaatctctgtcccctgttacgaccgtaatgtccgcttcattcgcaaataaatcggcaagagtaccgatacagtcatccgcttcatagccggcaaagccaatattcatgattccaagctctgcggctgcttcctttgccaaatcaaactgcggaatcagctccacaggcggcgcgctgcggttggccttataatcttggaacaagtcatttcggtacgttttgctccccatgtcccagcagcagacgacgtgtgtcggctggaatgtttccacagctgtaatcaaatgctttaaaaagccgttgacgccgttcgtcggcaccccgctgtcatttatcataaagttgcgatgtacggccgtggcaaaaaaggcccggaataaaagagccatgccgtcaaccagcaatagtttattattattcatcaaataactcccttttctttcattccttctattttatcataaagcagcccaaaaataaaaaacagtatctctttaattagagatactgtttggatatatatcaatcgttgtgtcttttgttgctggcgatcagcttttcagcttcgcgtcctgcgtaagagtcaaaatgggtttgaaatccgtttttctttttggcattgttattcgcctgtgcatttctgtttccgagctttgttctgcccaacatgaatccccccttacgtcggatgcatatagtatatgcttccggcaggaggttcactcgcgacaggatcatccagcttacatgcggcttacgtattctctgaccatttcttttgatacaagccgtcttgtcgggacgatgccttttttagcgagctgattcatttgctcggtaatttcattaattgcatctgtagtataaggctcatcgtttctgcatttagcaacagcttcttcaatcgccaattcacgcatattttcaagacgcataaatgctttgatatgctcgtgctgttttgatgaatgtgctgaaattgctttatgtacctctgacattaatcgttcatctcgcttttttctatttagtctatcatgacttgaaatacaagccaactgaattttacatttttattgtattgtctgaatttttccaggagatgcaagcctgatacgccatttcaatctctttcgcatgttccccttccgcatatcctcttaaatatgtctctttttgatccgttatttgcgcgattgctttttcgcccatatcttcctgtaagcgtctgaggtgagctgtgtaatgagagatcaggctttcttcttcattttttatccatgcctctgtgattttcgtaagtttcatccgcacagcttcgataaaggccgattttcctttctgctcaaaaaactgcttcggtgatttgatctcttttagttcctgctcaaaagcacgttcttctatttccggttcaacttccttcaactgtatgccgttcgaatgctgatcacccgcataaacggaaaaataaccgtcctcgtttaatgttttttgaaaatgatccagccattcttcattgatatgccgttcgatgaaaccgctcatgcgaacatcaagcgttttgatttcctgaatatattcaaattgatattcatgtaaggctgttgtcatcgccttactgacgttctttttccaatccccgttttgcagcccgggatgaaatgcggattttaataaatcatttgcaaaatatgataatcgctgtgtaatgtgatatagctgctctcttgtatctttttttactttttcaatgatggtttttgagttccgccgtttctcgatatcggcggctgtccgctcaaatgacagcataaggcgctgtttctgcgcttccttctcttctcgggactgatgctgggattggtgaagctgaaaaacagtttcgcatagtttgtctgcctccgaactgagctgcgctgctgacgctttttttacatccacttcgataaaacggtctaagtgttttcttactttcgagaactgattataaaatgactccggttttcccaccagttcctccttacttgatacggtaaagagctgcggctcataaaccccttcttttacaagctctgtgctgacataatcggtcactgtttcgagttctgttttatcttttgcaaggtctgcagcattaataataaaaaacattttatccatgctgagcgattctttcacaagtccaagctttcgcaaaaatgaacggtctccttttgaaaaagagtgctgataataagtcatataaaaaaatgcatcagcatctttgatatattggaatgccagttctgtatgccgtttattcatgctgctcgcgccgggtgtatcaacgatcgtaatccctttttcagtgagcgggcatgtatagtagaccgttacctcttttacaacacaggccgttgtttcctctgctacatacggctttaattcagatagcggaatcgttaatttcttctgttcctgtatatactgctgatacttctcatatgcaagcaggaaattgctgatcaatttcacgtgttcttcctgcagcctgttttttttgactgccttttcccacttctctgtgaaggaacggcctgccggttcctttggtattccggtgagctgcaaaatttcagccgttatgtcatcctctgtcttaaacactacatccgctgttttgtttaagttgccattgattggcattgtgatcttgttaattgtcgctgtggttggcgttggtgaggatggcagcactctttcgccgacaagcgcattggcaaatgatgatttccccgagctgaagcctccaaaaagagcaagtgtaaatttccgttcctcaagccttttcaccctttcacgaaacgctgaagtttgctttaacaacatgctgcattcgcctaaaaggtcagacaaagtgtaaaagcgtttgatttggtcttgaagcggcatttcttgttccattttgatttctgatttcggcatcggctgcgccgtcagctggcttcggccttgtttctgctctggagccgccactcttgttttcttcgatttaaaccattctgtgtctatatgcattgggcatgcggactcttcttcccaaatggcccacaggcgatcggttttctctcgggcattattctctaaacgcgcctgttcttgaagaaagacaagtttttctgattcttggacgagccggtcgttaatcgtttgcacgtctttggaaacacgctctttcaccatagcggagagcacctttatgatgtctgcggcttctcttttcgcctctttccggatgagctctgccaaatcttttgtatattgcaatacatattcagaagaaaaggctgcaccatgcttgaccgcgcgttcaatgatgcttatatcaagcggtgtgcgataggcctgaatcagcttttcactttcagcggtatagacatcaaatgccttggcgagtttatgaagcgtgtctatcatatgccaatccgcttcggcctctgttcgttttgccacatcagagaaaaaagcattccgccttttatctctttcctgtgcagttttcgctttagaaaagaaaaagccggttttaaaggaaggctcttgtgattctaaaaatgcagccgccaattcacgcatttcaaaaggcgtcaggttggcgttttttaaaataagattgatttcttcctgcatcctcttctctgcctcagtcgtttgtttttcggcctcatccaattgatcacgcagcgattggaccagtccagtttggatattaagctgttcagcgaaactcggagcgcctgtttcgtctttcttcagcatttccgtatgttcctttagcagattacggactttttgttcggttaaagcctgcatattgctttttgattgctgttctattcttcttaactcttctctcagggcccccatctgattgaacgggtggtccggttctgttactgacgtaaaatagagcgcttcctttgaaatcccttcattgcaaagcatctcctctacctgcgctttatagtctccaaatttcgtctccgtctcatcatggcggtcaatttgattgacgataaaatacacattcggaatgctttcttttattgatctgagaaactttacattttcctcagagtgcacgtgattatagtgaacgacgtaaaacagcgcatccgcttggtgaagaatagaagcagccgatagaaaatgcgcatcatctgttgaatctatccctggagtatcaatatacgcaaccccggaatcgatctcagtatacctgtcaaaaatttcgacgctttcaatctgttccccgtctttacaatattgctgcaccttgtctttctggtaagccccttccagctcagcacacgctccgtctgttgtatgaagccgaactcgcttttccccgtttctgatcacaacaaggttagcgcttgtcggaatcgggcttgtcggcaaaatattctccattaacaggcagttcagcagtgacgatttccccgctgaataatgcccggtaaacgcgatataaacctcttcatcagccgcttttttcatgaccgcagccagtttagcagccctttgttcatcttgattctcaataaattgcttataaagttccccggttttatgcaaaagctcttttctgttttgatctgtcataagtctgaacccctttgtgccgtttcaattgtgaacctttttcgaaagatctgaattcattcccttttcattttacacaagaataaaccaaatttctttaggagaatagaaaaaagccgccattacggcagcttctataaaagaaaatctgcaacttttacaagttccagattcatcaaacagatttattagagattccttttaatacaaaaccaattaatacactatatgtacaaaccgctccaagcaaaaacagcattgtcatttgcttcaccatcctgattgagaatctttttcaaatccattttaacatggttgagaatgattttcaatcgctattttacgctgtattcctgtaatgctttgtcttctgcgcgaattctgacgcttaacaacactgcattgaaaatggaaaacagacacatggtgacgtatgcttgataaagcagcggaatcaacaaaatttcgagtataacaacggcatagtttggatgtttcatccatttatatggacctttttttacaagctctacacctggaacaacaaggattttcgtattccaatatgcccctaaggaacaaagcgcccaataccgtacgatctgtgcgcttaaaataactgcagcgataccgagccaccagctggacggctgtttattcatcagcagcacctcggcaattaaggacaggaaaaaaaggatatgcatcgtaatgatatacggatagtggctctcgccaaattcaattgctccttgcttctttaccttttgttcgttttgcctggccactgccatttctgctgctctttgaacaatgagaatggcgatcaacaaccaaaacatgagtcaggcccccttttcccagctgaataacagcaattctgatgagaaacccggccctaatgcgccaatcagtcctcgttcagcttcctttttatgtccgttctgcagatggtctttgatcacatacaagattgtggctgaagacatatttccgtgcttttgcaaaatgctttgcgcagatgaaagcttttctgacgacagcccgagacttttgatgtatgcatcgatcactttttttccgcctggatgcgccaaaaaaacactgatatcatggaatgacagcttatgtttgtccaaaaaaatctgtacatttgttttgagccatttttccaccaaggtcggaatgtctcgtgagaaaatgactttgaatccttgatcggtaaagtcccagcccatgacatcttctgattgtttcatcaaaacagattgggcgtccattatcttcggcgcaagttgcagctttgacatcctgcggtccgccttctctccgcataataaagctgcggcaatgccgtcaccaaaaagcgaggtgccgatcagattgctttttgttttatcttccggctggaatgtcaggctgcacagctcggcagcaatgacaagcacaaaagccttaggatacgctttgcagtattcggctgcacgcgcaagtccgctggctcctcctgcacagccaagcccccaaatcggaatccgcttcgtatatggagaaaacggaagttcattcataagccgcgcctcgatactcggtgtggaaaggcctgtgctggagacgaaaaaaacagcttccactttctcataaggaatggcttcttgaaaaaattccggatgagagaggcactcacgaacagccgctctgctgtgtttaagtgtttcctctatgtatatttgatttttttcttcaaagctgtgcccctctttataccattcaatcggcttaacaaactgtctcgaatggatttgcccgtttttaaaggaggataacagccggtcaatatccttaaaagaatgctgaaacatatagcgggcgaactcggccgctttctcttggtttacattatacgcaggaagacttgttccaatggataaaataaacgccatgcgatcacctctttgcatacattgtgccgcaacaatcttttttatatgcaaaaaaactccgccgcggcggagttagactgctgttttttgttcagcgaggtcagcttcttgttctgtttttttagctttagaaaaaacgttatatacaatatttaagacgactgcagtaaagctgcccgccacaatgccattcgttgtaagcagcgttaaggcactcggaagctgtttgaaaatatccggcacaacggtcacaccgagccccaatcccactgagcaagcaacaatcagcagattttcctgtttcgcaaaatcaatgcggctgagcattttaattccgtaagcaatcaccattccaaacatcgccaccattgcaccgcccaaaacagcggatggaataatggtcgtgaaagcagcgatctttggaaacagcccaaatgccattaggatcacacctgtgaccacaatgacggcattttttttgatccctgtgagctgaacaagcccgacgttttgagagaatgccgtgtaaggaaaagcgttaaaaatacctcccagaagcacagccagtccttcagctcgatagcctttagacaaatctttctctgtcaaatggcggtttgtcaggtcacctaaagcaaagtatacaccagttgactccacaaggctgacaattgcaacgatggacatcgtaatgataggcgctgcgtgaaaagacggcgcgccgaagtaaaatggctgaatcatttgaacaactgccgcgtccgaaacattatcaaattgaactttccccataaaataagcgatgaaggtgccaatcaaaataccgatcaaaatcgagacggacttgataaagccttttgtaaaacggtacagaagcacaatgatactcaacacggtaaaagcaagagcaaggttggagagatctccgaaatctgcacttccttctccgccggccatgttattcatggcaaccggcatcagtgtaataccgataatcgtaacaacagagcctgtcacgaccggcggaaaaaacgatacgagctttccaaagaaaaatgaaataagaatgacaagaatgcctgaagcgataatgctgccgtaaactgttgaaaccccatattcagatccaatcgcaatcattggcgatacagctgtaaaggtacatccaagcactaccggaagcccgatcccaaaaaatcggttgctccacacttgcagaagtgtagccacaccgcacataaaaatatcaattgatactaagtaagtcagctgctcgacggtcagtcccattgcttttccgacaatcagaggaacgacaatggcgccggcatacatggcgagaacatgctgaatccctaaagacagcgttttgccgaatccatttctcatgaatgaacctcctgtacgaaggacacttttccttcttctaaagactgaattcttgccaaagattccactcggtagcccagttttacaagttcttctcttcccggctgaaatgacttttcaataacaatgccaattcccgcgatagaagctcccgcttgcttcacaatcgacacaagcccgtgcgctgcctgtccatttgccaaaaaatcatcgataatcagcacatgatcctgttccgacaggtgggtcccagacactgcgatttggctttctgtttgcttcgtaaaggaataaacagacgctgtcagcaagttgtcggtgagtgttaacgatttatgctttctcgcgaagacaactggcacacccagcttcaagcccgtcattacagcgggggcgatacctgatgattcgattgtcacaattttggtaataccgtcttttgcaaacctggacgcaaattcgtcaccaactctctgcataagcagcggatcaatttggtgattcaaaaaagaatccactttcaatacctgatcagataatacgacgccttcttcctctattttccgtttcagtgcttccatcctgtcttacctccgttatgagaataaaaaaagcattgcccgctcaaataaagagcaagcaatgctgatatcacaaaaaaccgtacacgtgcggttccattgctcacccatagtcggacatttacggtgcccggtagaaacttgcgtgccatatccacgcgattatatgagtgttcctattatattgtaataaattatatcaagattctaatctcttgcataggctgaaaataaaaattcccgaactttatttttgtttttttagatatcattcgtatttcaagggtatacgatataaaagagcctgacgaccgcgccgccaggcttttgattatgacagatagagatttgaatatttgtttgataaataatcaattaaatagcgaacattcagctcttctcctgttgcatctttaataatgtctaacggctttttccgttttccgtgaatgtgcaccttttccgtcagccattgctttatcggatggaactctcctctttccaagagagcgtcaaattcagggagatcctcaagcattttttgtttcagctgagccgcatacatgtagccgagcgcataggatgggaagtagccgaaatctccacctgcccaatggacgtcctgtaaaatcccctctgcgtcggtctgcggtgtaatccctaaataatcctggtatttttgattccaaagcgacggcagatcttccacagacacttcattgctgaaaatcgctttttcaatttcataacggatgatgatatgaagaggatacgtcaattcatccgcttcgaccctgataaatgaaggttttgattcattgattgcccggacaaaatcatccagggagatgtccttgaactgttcaggtgatgcttcttgaatcttctgatagtacggagtccaaaaatgcttgttgcggccgataaaattctcgtaaaataatgattgcgattcatgaattcccattgatgcgccgtctgacaagttcgtgccactgagtgcttcatcaatattttgctcgtaaatcgcgtgcccgcactcatgaatggtgccaaagatcgccgtccggaaatctttttcatcatatctcgtcgtgacccgaacgtctccccgattcagcgtagttgcaaacggatgaacggtttcatcaagtcttccgccatcaaaatcgtagccaagctcctgtaaaaaatacagactgagctctttttgcttttctttcgggaacgcttttgtaataaagcttgtatctggtttatttccggaagctgtcacctgtttaacaagagggataatcgcttccttcagctcagcaaacagctgatcaagcacctttaccgtgacgccgggctcaaacaaatcaagcaatgcatcataaggatgctcttgatatccccaatacgtaataaaacgtttattgaattcaatcagctgttctaaataaggagaaaacaagctgaaatcagattttcctttcgcttcctcccacgctgtttctgcctttgaacacagaatcacgtattctttgtattcagcctcagggattttcttattctcttcatactcttttttcgccagttccactgcttttttcgtatcttccgacaagtcatcaaatcgttcatacaggacatcgataagctccttcattcgatctgatgtttggatattgaatatatctgttgaaagctggccgatactttcggcacgatcctctgagccgtttttcggcgcgcctgttctggagtcccagtgcattaacgcaactgcttcgctgtaatgtgagattctttttaaaagatcaaaaaattctttttcatatgtatgtatctccatatccattccctccctattctagccgttccattacaggctaatggaagggggtatgaaagtcaaattgtttgtataaaaggctgccggtatgttttgtggcagcctttttattcagttgatcgtcatttgattttttggaggaggtgttctccgctttttctgcttgatttttttatctacccacactgttgccagcggggttaagagcgaggtgacaataacgcttgtcgcgataattgcagttgccgactcagcaactggcgcaaatgaggcattcgcttccgctaatgcatatggcacggctacagccgcccctgccgtagaagaagcggccactcccgcgacaccatctccccgcgcaataaaacgatcaagcaaaaacaaagaactgcccgataaaatgacgacagaaactccgataaaaatgccgagcagccctgattggatcagcattccaaaattcaaggtattgccgagcgaaaaggcgaaaaatggaatgatcgccggcacaaccttgctgaataagtctctgagatcatgatccagatttccaagtatacatccaagtaaaaacgggatgactgtcgctgccagcgtttcccatgggaatgcggcaagtcccgtcacaccaaacgtcaccatggtcataaaaggaccagattctgtactgataaaggcgaaagcgcccgcatcctcttttcttcccatgtgattcatgagcgccaaatacagtccgccgttcgtttcattcattaccgcgacaattgctaaaacagaaaggcctgcaaaaaagccggattgtatgccttcgtcaggtataaattgcgctgcgatcacgccgagcagtgccgcaaatccgacctttcccaataataacgtgattccttttcttgcgatatagcctgaagaacgaaaatcaatcgttgctcctacgcaaaagataaaaacacccagtatcggcagcgttccggtaatcaaagcacccgtaaaccctccaaagaactccgctgttccaggcgcaaacgtgttgagcgccgctccaagaaatagcggaataatcatcattccgccaggtacctgttcaattgtcgccttgattttcatattgtggattctcccatcctccggttatgaaaaaacaattccacttacacttggaaaacagcctgcaaatcctcttttgaacagctgcccaactggctgccgactccgacggcgccagctccggctctaagccaatcaggcacttcagacggatgtatcccgcctgtcggaataaaggtcacctgcgggaaaggacccgctaaatttttcataaacggaatgccaaacacaccgcttgggaacagctttaatgtcgtgaacccgaatgtcaacgcttccataatttcgctcggagtcaagacgccggggatataatgtgtctttacaaaagatagatgttcagcaagatcagctgaaaaacccggactgacaataaactgcgcgccagcctcagcagcttccccagcttgctgcgcgctgatgaccgtgcccgcgccaattaaaatatcttccctattacggaaggattcgataatatctgatgccccgggggtcgtatacgtcacttcaactgcacgaatccctttatctaataaactctcaatctgctgacaggcctcctgcttatcctttgaacgaatgactgcaatcagctttgcttctttcagacggttttcaacgactttggactccatattaataatcccctttcttttggtgaaccgttctttgagcagataaaaaagaagctaatttctccctggtcggcaaaccgtccatatcccccggtgcctgcacttgcaaagcgccaatcgcatttcccctttgcaccgcatccttgtacgacaaaccgtctaggataccgctgattacaccgactgcaaatccgtctccggcgccgaccgtatcaaccacccggtcgacccggcagccttctagaaatccttcacttgtccccgttttaaagtaagcgccttcttttccaagtttaatagcaacaaagctggcaccttttttcaaataatagtcggcaatgccttcaggtgttttttctccggtcaatagctctccctctgcgatacccgggaaaaaccagtctgcaagcccagccagatcattgattgtgtgtaccattgttgcttgatcaggccaaagcgaaggtcttacattagggtcgaatgaaatggtcttccctgcgtttctcatgtcgttcatgacatgatacgtgaagtctttcatctcggctgataaagcaggcggaatacctgtcacatgcaaatggcctgcgcattgaaaataatctctcggatattcagctgtagttaatgtgcttgcagctgagtttttcctatagtaggtaacttgcgggtcgccttctttcacttttgacttcagcagcagcccggtgggattttcgtcctgcgagcggatcacgcgggacacatccactccctcttttttaagctcttgtaaaataaacgttccgagctgatcattgccgaccttgctcatccatcccattcgaaatccgagtctggcaaggccgcaggcgacattgctttctgctccggcaagccctttagaaaaagtggatacttcatgaaggcctccatactcatttgcataaaacatggccattgattccccgaatgtcaccgcatcaagcttcatctcttcccaacctcctcttagttgagggcacctaggattaaagtgactttctcatgatgacttttgcctctaattcaatggtttgaggcgctcctttgtcaccttcaatcctttttaatacacgttccatcgccgtcctgcccatatcatgtgacggctgggcgatcgttgtaatacctggaccgatcagtttataccattccgtatcatcgaatcctgcaatccctatatcttgagggatgcgcaggccaagctcttccatacagctgatgattttcagcataatcaagccattcaaagccagaatcgcttttttttgctccggcatttccttgtgaaaagaacgaagcgccgccttaagctgctccttgtcctttacgtcaatttcatgcaatctgaccccgttcacattatgaaccgaagccatttcctgatacacagctgctctttctgcacgagggctgatagaggaaatcggttcggtaaacagcgcgacatcagtataccctttgctgtacaccttctgaagaatctcttttgtgatccatctgttgtcagtcgttacggtatccagtttcagatccggcagtttccggtcaattaagattgttggaatttgctgttcagcaaaagcgcggagtacatccttgttttcccctgttgcgtttaaaatcaagccctcaaccgaatgggcttctagctttaagagcatttcccgctctttttcaggactgttatctgtgttgcacaccataatgctgtaaccatattgatcacaaacctcttcgactcccctgaaagcagcgaccgaaaaaggatttgtaatgtcagctacaacaaatccgattaacttgcttttttttattttcaaaccttgtgccattttactcggccgataattcaattctgcgattgcctttttaatgtttttcactttttcaggagaaatcgcgtcaatttttccgttaatatagcgggaaactgtcgatttcgaaactcctgcacattcagctacatctttgatggttgtatggcctgttgttttctttttcattcaagtgctcctgtatctcatatatttgaaaccgatttcaaaaccgttacaacaaaagaataccataattttaaaatttggaaagagtttttttaataatgtgtcaattcattattttccgttgactcttttcactatttatcctaaaattttctttgaaaccgttaccaaaatattttcattcaagtgatgctgaaatcctaaccaagggggaaatataatggaaaatcgttattctgtacatcctgaacaagtaaaacgctttacaacagaggagcttcgcagtcatttcttaatggatcctttatttacagaaaataaactttcgatgtattactcacatgaagaccgggttgtcatcggcggagcggctccagggcaaagtgaactgaagcttgatgcaggtgattttctaaaaacagacttctttttggaacggcgtgaaatcgggattattaatgtcggccagcctggtgccgttagagtcggcgatgatgaatatgtgcttcaaacaaaggattttctctatatcggaatgggtaatcaggatgtatcattttcaagcctgaacggtgaaaaagcgaagttttacttcgtctccgcttgcgcccacaaaagctatccaacacaaaaagccgccctagctgaactgacaccggaccgccttggtgatgatgcagcgtctaatgtcagaagtctgtacaaagttattcatcaggatggcattaaaagctgtcagctgatgatgggaataacgatgttagatcaaaacaacaactggaataccatgccagcacacgttcatgaccgtcggatggaggcttatctttatctggatcttgaaaaggattcaaaggtatttcatttcatgggccagccggacgaaacacgccatcttgttgttggaaatgagcaggctgtcctttctcccgcctggtctattcattctggcgcaggaacatcaaactatagctttgtgtgggcgatggctggagaaaattacacatttacggacatggatctcgttccgatggatgggctgaaataagatgggttatctacatgacgccttttcattagaaggaaaaacagcgctggtgacaggccctggaacagggatcggtcaaggaattgccaaagccctagccggtgctggcgctgatattatcggcacatcacataaaagcagcctgtctgaaacacagcagcttgtggaacaggaaggccggatatttacatcttttacattggacatgagcaagccggaagcgataaaggattctgcagctgagctgtttgaaaacaggcagatccacatccttgtcaataatgccggcattattcatcgggaaaaagcggaagatttttcagaagagaactggcagcacgtactgaatgtcaatctaaacagcctgtttattctgacacagcttgctggcaggcacatgctgaaaagaggtcatggaaagattattaatattgcctctctcctgtcttttcaaggcggcatcctcgttccggcttacaccgcgagcaaacacgctgttgccggtttgacaaaatcatttgcaaatgagtgggcagcgtcaggtattcaggtcaacgcaatcgccccaggctatatttctactgcgaatacaaagcctattcgggatgacgaaaagcgaaatgaggacattttaaagagaattcctgacggccgctggggccaagcggatgatatcggggggactgcagtctttttggcatcacgtgcttcagattatgtaaatggacatattttagcagttgatggcggctggctatcccgctgacaaataaaaaagctgacgaacgatcgtcagctttttttcattacatcatgtgcggttcaacaggcaagacctttttgacctcatcgatgatgcgttcattttctccgccagcgtaaatgtgaatcgagccgctgtcttgattcgagcgaatcaggcgcccgatgccctgccgtacacgtaacaacatatatggcagatcaacttcttcgaacggatcttttttcgctccgttgcgcttcgctgtaaatacaggatcgtgtggcgggaacggtaatgaccaaatggtaacattcttcaatgcgtcaccgggaatgtcgagtccttcccataagtgaactgaacaaagtactgtttcttcttcctcttggaatttctctactaagctgctgatttcctcatcaccttcgaagaaaattggatacggcagctcccatgccgccgacagctctttaaactcgtttaattcttcaaaagaagggaaaagcaccagcgttcttcctttgtatcgtttgattgtttcaatcgtttcagccgttttttgttcagcggccatatctgtttttgcgtataaattaatactcatttgctcgtcataatcataaggggaatcaacagttaatgacaaataatcatgaatcccaagactgtcggcaatataatcaaacgaaccgccttctgacagcgtagcagaagagaagatataaggaattttcttagaaaacactttttcgccaagtacttctgctaccgttctcggcatcacgacaaaagttgattctgcttcctttttctccagccagctgattgcatccttttgatatagagataatgaatacgccatttgttcaacatattcttccactactgacaactcgtattgatcaatcgtatacatttcagactcaaatacaagtgcctcaccgattttatcaagtaaacggcaaagctcgtccgccgcctttttgacacgatggtcattttttatttctaaacggtgtgaaccggctacttcctttgattcttcagaaagaacatagaaaaattcgtcgtttgcgagaagcgcatcttcaatcaattctgcaaactcttctctgatgtcattttgcagcaaacgttctaaaaacaattcaagagtagactgcttcactctataggttagcgctttttgcgcagcaaactctaacaaatgcccctcatcaaatacaactgcactatgatcaggcaagagcggcagctggccctctcgtttgcgtgattcttccgtccacacatgctccatataaaaatcatgggaacaaatgattaagtccgttgacttgcggtagtaatctctggaaagtgtcagaccgcatctgtgtctcatatcacaagtcagacagtcctgaaacgagtcgtagcttacgtcagaccactcttcattcgatagatttgcgtactgcttacggtcgccatacggataaaagcgctgcatcgcctgggactcgtggacaaatgacggtaacgactcataaagatccagccatttatcatcatcagaacgctgcattgttttttcaagcttcttcaagcataaatattgctcatgtgattttgacagccttgtatcaattttcaggtcaagatgctcagccagcttagaaatatcgccctcttttttcaccagctgttcaattaatgtttcatccgcacaagcgatgatggcaggtttgccgacataccttgcatagctgattgcaaaaagaagatataccagcgttttccccgttcccactccagcttcggcgaacatgacttttttctctttaaacgcccgctccagctgaaaagccataaatacttgctcgtcccgaagatcaaaccctttttcgggaaggatatcgtaaaacacgtcaccaatccaattgttcaattcttcataaaaattctttgttttcgttaaagaaaaaggcaaacgtgatgttgtcacctagttccaacccccaactattcgacattcagaccaccaataatatcattttccgctgatgaatacaataaaaaaacttggcaatgccaagttttttgcagtttacttacgattgatcacatgcgacgataaaaaaggatggtctgttgaataaatatgttctaccgctttttctaaatcagtttgcgcatgcgaaatcacagacggagacgaatcagtcccgagctccttcagctcgtttgctgttgcgtcaagcgccctttgaataagattaaaatgttcgctgttcagcatgagatcacctctgatggaaataatcatcattgtatgcgaacttttcattttatatacatgctttaccgcatgttatcaccgaaacatgcacaaactacacttgatattccgtctccggattatccgtcttatcaacaatattctatcagggagtgatgttgacatgagttatagaaaccgattagatcagcattctgaactgtttcatcacaattggacgcggcctaaacgttctaagtctcaagtaaacggtcacactgaaatgtcccaaaccaacattatattgagaagcaacgcgaaagctcaccgttggtaacgatagaatagggctgaaagatgaaagaagacgcatgcagagcgtcttctttttatgcgttttctgttttcttgcgctgcggtcttacttttgaccagtattgataataatccgttttaataaacccgttaaagagttttcgtttcttcgttgcttttctgccatatgcttcctcaaagttttcatttgatgtcagcatatacacagaccaagtatcaagcggctcgaacgccttccccatttctttgtacatctgctcaacggcttttttctcgccgagacgctctccatatggcgggttgccgacaattacgccaaattccagatttgtggtaaagtctttgacctgcatctgtttgaactggattagatctcccaatcctgcttcctctgcattttcttttgcgatttgaaccatgcggtggtctatgtcgctagcgaaaattgtaagcggctgatcataatttgccttttcttcgacttcaagccgcgctttgttccacagatctttaccgatccattcccaatcctctgaaacaaaatcgcgattgaatcccggggcgatgttttggccaattagcgccgcttctatcgcgattgttccggagccacagaaaggatcaacaaacgggcggtccggcgtccaattggttaattgcaccaaagcggcagcaagtgtttctttaatcggcgcaccgccctgatcgacacggtatcctcgtttgtgaaggcctgtccctgatgagtccagtgtaatcaaagcctgatctttcaataaagaaatttcgactttatactcggcacctgtttcttcaatccaatcattggctttgccggactgcagcttgagcttttcgacaattgcttttttgacgatccgctgacagtcaggaacgcttgcaagtgttgattttaccgattttccgatgacagggaatttcccgttttcaggtataaatgagcgccagttaatcgctttcgttttttcaaacagttcatcaaatgttttcgctttaaaagaagcaacctgaacctttatgcggtcggctgttctaagccaaaggttcgcacggcagatggcaagtgcatcaccttcaaaaataactttcccgttatcaaccttgcattcgtatcctaaatctcgtacttcctttgcgacaacagcttcaatgcccatcggcgccgttgcaattagtgtatacttcttcatcgtatcaccctgtcttttaaaacttttctcttttcaagataaaagctctccttatacgggagagcttgttttcatcattttaaatgtaagtggtctaacgttctgtaagccatgttttgttccatcgtactgcaaacggctcatcacctcgtactcaggcggcaatcatctatctacagaaagcattctgtccttctctccgttgaattccgttaagaaggttcccctaccaaaatttgggtttctcgctcgaggggtttaccgcgttccactctcaccatttctagtgagacttcgtcactgtggcactttcaaggatactcagccatatccgaagacgtaggcttttttcctgccgtcagcctctaaagactgccctagcttatgacttcgctaggcacgaacactacgggcatctcagcaccgtgcgagcatggactttcctctacagattcaagatctgcagcgattacccgaacgttaagaacatgaattattatataacaactgattacaatttacaagcgccatttttttcaagcgtgatcaatcataaagcttgctgccaaaaacgtgtttttctaagttagacagccgttttaaaatatcaaagtttgttgtgttagattgcacaggctgttttttgctggcttcttcaagctgttttttcagctgcagattttcctgctgcagttcttcaatttcttgatggaaggtttcataatccttaataatcatatctaaaaatttgtcaacgtcttcttgcttgtagcctctaacgcctgttttaaattctttttccaaaatttctttcgcagaaagctttactttatcagcaagcatctttttcacctcgtatcgtgaatcatcacatatattttttcagaaatctgtacggttgtcaaatttctcttattgctatgagtagctgtcttcctctactgtcactctcaagtcatccattgtaataaagtagatgggatagccatccttttcgcgccttttttccgctgtcccaagcatatacttaggggagccttccttttccgggtcatataaaagcagaagcccgtcggacttatcaatgaagaactgatttttttgtttgaattgaagcgggctttcataaggacggtgagtcaggcttgcttcatagtctgcctgagccagaactgcttcatacagttccttattcggttctttccagttcttttcctgctcgtaaaatggtgtgatgacagctacctttaagtcagggtattcctcctgcaaatcatatgcagcttctgccgcccacagctccgctccaagctggcccgaaattaaaatccattctaatccttcatccaaaaaagcaatcagtcggttcttaatggctttttttatgtaatacagcgccttgtcatcctgcttaaatatcccgagttcaaacggtttatagcccgtaattgccagtactttcatcatttcacctgctttaaaaaatggggctcccgtgggccccatttgttgtgctgcattgtttacaccatcaagctgcacgtttccatactagtagtcgcagcaaggttttcctgcttgaaaatgctgatgcgtagccgggtcaacatttgagaaagtgtgtggaaagtagtgaacgtgctgaaaatgctggtggtttacgtttgttgtatgctgtgggtgaatgtgcggcacgatagtcttcgaaaacgtatggtgttcacagcaatgagtaggatggacaattggcgccatcatatgcggtctgcagtgatgcatgataaaatcccctttccataaactttattacaatactaagctatgaaaaataaggggtacatgttctgatgcaaagacctattttaaaagtgtgcaattaagctgtctttaaagtttgaaaatacaaaagcaatcaaaaataccacaacaaagaacaagtaaaaaacacccttatacataccaactctccctttaaaaataactaacgtcattttacaggattcgccgctattctacaacaaaatcaatgtgaattcagcaaaaaaattcatggcgaaacaagtcgtcttttgcgctttcccggggaatatttaagaggaatatttcctctttagccgggcaattctcacatgcagtttttcagtttctttctctgataagcatgccgcatcgctaagcgattgctctgctacttgcaatgcttttccgaattcttttttcttatgctcaaaatatttcgcgagctctattacagcagcgtatctgcacttctggttttgcgagcgggacagcttttcccaaagcggcactgcttcttccaagcggttttgttttttgtacaggagcgataaatccagccgtgcactgtcctggtcctcaaacgatttttctataagcctttccaactgcttgatcgcttggtccgtttctttatgagccataaaccatttcgccatagcataggcttcactgtgttcttttggcgcatgtgattctgaaaggatttttttagacatatggatgtacaatgaaatgagtgataacacatccatttcattatgatgcaggacaccttttaaaagatccggctcttgcgccttgataaaatgaaagtaaagcattggcgccaagtagcccggtgtgtcttctagcctgcggatgccgagctcctctttttcaaccgtgccaagagatacacggtccattttgtgtttccacaggcgtctagctccatgcaaaagatcaaagtggccaaactccggaagcttcggaagtctgtcacggatcaaggtgtgccttgttttcacctgcggccaatcaaaggctttgccgttgtaggtcacaagtgatgtaatgtcaacctcgcttaaaaagctttggtacaaggcgacttcgttccccggtttgggcaaaagatgctgtttgactgtcactcggtcttcatatactctcgcatgcccaagcaaaaaaatggtattcccagctccacccccaagaccggttgtttctgtatcaaagaaaaagaggttgtttttgttatacccttttgctgacaatgtatgcgacaggccgctttgattccacagtgtgatcacttcctcaagctcagaaaagctgtataacccatggcggtgagaaagcggatattctacttctctgatgaggcaatattcatcttcgaagatgaaaggcttcatgccaaaagcctcccactcttctaaaaacgggatgtcatcaaagtggttttcttgtttgcctgcttctattttttgttctccttcgtcgagcgccatgtgctttttcatccgttggagtttcccttttaatgacatatccggcctccctccttacgacatttgatccaacagctgcaaaattctttcctttgcttttatcccttctatttccgtacctatacaagacggacagccgtcatgacaaggacaatgtgtaatcagttgtttcgccgcttcattaatgtctgaaaaacgtttaaagacttcctccgccaaaccgataccgcccggataatgatcatataaaaatatggttggcaatccggtatgggctgctttaatttgagaaacaacatgaacatcatttcgatcacacatgatatacacagggacaatatgctgcagcacattcgagatgccaagaagcagctgttccagtgtcttttccccgatgtcttcatccgctgttttgatttcgagccaagctgcacttgtatgcagttcttcttccggcaaatgaataggtccagacccaatattttcaaaagtggtcatttttatttttttaaaaatggtcggcagggcattgacagtgacgtctccgtagtgcaatgacgtacggcttttttctttcgttttatcgatttctaataccttcagctgaactgccaggtttgcatccgtataatattcgacatcgacttttctgacatacgcctttttatggtcccaatcgagcttctcaacttgatactgaacgccttcatgcaaataaatcgcttcatcatgcaaaagcgtcatcgcactaaaacggtccatttcaccgataatccttacatttgcaatatccgactgatcaactataacgacattttcctgggaggcggaacgcaaactgatgtttgacgcagggaacgactcacttgcccaatggtaccgttcgccgttgcggtgaagaacagcctcttcctgaagatactcaagaatatcactgacttccatggctccaaattcttcatcagctctaaaaggaagctcataagccgcacactttaagtggtctactaaaataatcaaattctccggattgattcttgcagattccggcgaacgattaaagaaatattcaggatgccgcacaatatattggtcaatcggtgttgaattggctaccatgataatcaaagattcaccgtgtcttctgccggctcgtcccgcctgctgccaagcacttgcaacacttccgggataccccgtcattacacacacttgcagctggccgatatcaacaccaagctctaaggcattcgtactgaccactcctaaaatgtcgccttctctcagtcctctttcgatttctcttcgctctttcggcagatagcctccccgatagcctctgattgattttgttccaatctcttttttcacaagctcctgaatatggcttaaaataatttccacccgaactctgcttctggcaaaaacaatggtctgcactttgtttttaaggaactctttcgccagttcattcacttctgcggttgcgctccttctaatattcagcggtttgttcacaattggcggattgtaaaacacaaaatgcttgcgtccgctcggtgcgccgttgtcatcgaccagccgcatcggtttgcctgtcagctgctctcccaattcctttgggttggcaatcgttgcggaagtacaaataaaaactggatcacttccataaaaccggcagatccgcttcagccgccggatcacatttgccacatggctgccgaacacacctcgatacgtatgaagctcatcgatgacgatatacttaaggttttcaaacaaactgacccatttcgtatgatgcggtagaatggcagaatgcagcatatcggggtttgtaatgacaatatgacctgcttttctcaccttttgtctgattgccggagacgtatccccgtcatatgtaaagcttttaatatcaatgcccatttcatcaataatttcatttagctcgctcttttggtcttgtgccagcgctttagtcggaaataaatataacgcccggtttgtttcatcttgggcgatggactgcaggactgggaggttgtagcataacgtttttcctgatgctgttggcgttacggtaacgatgctctctcctttttgcacatattgaaaagcggaatattggtgagtatatagttcatcaatgccccttttcgaaagggccgctttgattctctcgtctatactttcgggcataggccttgtttttgcttcccgaggctcaatttcatgccaattcacaacgttttcatttccttttaaatcagaaatgagttcagtcagtgatttctttttcattctttacacctctttgtcaagtacagtttaccgaatatttgtttgcatggctaggtgcaaattttatacagttgaataaaaaaagcaaggcatacgccctgcttatttcgcttttattgtaaggagctttgattcgcctttacgagcagccttttcgcctgccggtaccattgatcctacagcctcaccattcattataacgattgggatgactgtgctgctcgctttttcttttattaattccaaatcacatgtaatcagcgggtcaccgaccttcactttatccccttctttaatgtgggcagtaaatccttctccgttcatattgactgtctccagcccgacatgaattaacagctcaattcccgagcgagtccgaatgccaacggcgtgtttggtgtggaaaatctgaatgacttcaccttcagcgggagaaacgatttcaccgctagaaggttccacggctattccttctcccatcattttctgtgaaaaaacagggtccggcacatctgacaggtccattactgtaccgtctgccggagaataaataacctcttctgtcaccttttcctgagttttgcccattccgaataattttttcagcaatgtattttctcccttctcattcacttcaaccgttatcccttcattcaccactatttaaccacactttcaattttgcttcaatttataacaacatctggcatagacgcataatctggttaaaaaaggcggtggcgaaattggaattctatgatgacaaaaagaacgaactgcaaaagaaagaagaaatcataacggaggcaatcgacactcttttccaatcctcagcgttcggcaaccttataaacggatttcagaacctgatcaactcgagtttaaaggatgtgcagacgaccatacatgtcagagaaagagatactgggctgtatatcgatattaccattccggcgacgtttcgagatggcgagatcgtcgttgatgttaaatcgaggtatctccatgtaacactccaagaaaaacagaaacaccaaaatgaggctacctttacaagcatgacaagaacggttcagctgccttatgaagttcgccaagaagatatggaaacgtcttggaacgagcagacaatgacacttttctttccaaaaaataagcatgaatgaacgattcattcatgcttctatcatttaaaaaagctggtaaatccctttattaaagatccgacctgattcattgcactcattacttgacctgtcgtatccatcattttattaaaatcaaattgcccattggcttttttgaactgcgacataatgctttgaaattgtgaaggctgctgttgattaggccttgggataggataagggttagaaaatacaggcggctgcataggcataggctggatcggagcataaggctgataataatcctgctgtccataatgctgctgaggcagttgttgctctaaataaccgggtgcagcctgctgataatatccttgcatatgctgaggataataatagcccatttgccgaggatagcttcgagagctcccgttcattgcgattcccccctaaacacaacatatttctcttctatatatgtatgaatgacttctattgtttgtgtcacaagtgatgattagcatttgtcaaattgtgtcgaaagtttaaattttttaaaaacagaaaaaagtcgaatcattatggtaccatattttcaatacagatgagaggggatgcaccataatgaacgtatcatacttaagcaaacgttttgcagaaatgaagaaatatgaaacagactgtatgaataaactgatggactttgccaagttcctctatattcaaggacatctcagcataactgagtttcgtaacagtatgaaggttctcgaagcaaatggagcagaaagcccggcatatgagatgaattaacgtccggccccctataaaaacgaaaagaagacagccttttaccggctgtcttctcttgcaatttcatcctttactgcgtgcaatgtataaaggactgactcagtgatgtccttgaatcgttttttatgaatatgatgaacataagattgaaggaccaattccaggaaattatcctttacggcctcaatttgctctttatgcacatattttggccggcggacttttatcaattcaagagcaccctctgcccagcgagcagccagttcatcattctcttcaactgcaggctttatcgtctcaaaaaaatcataagaatgattactgttttttccttcctgataccgatcagcgcctttttcagcaacttcaatcatttgctcggtcatttccagcaaagtttgtgatagcaatatctttcacctcaatgcctatcgtaccaaatttcactcacaaattcagccgatgcggtataccttctcaaacgcatacctgtgttcaggcgattgatacagctcatttatacaaatatgaagatctatgatttcttcttcgagcacacttaggcgatcgttctccgtttcccgcatctcagcctctaatgcatttacagaatgattcaggctttgctcagctcgcgttaattcatcttctatatcagaaagcatacggagaatatctgtcttgcatacataaccggacattcgtgtacctccctttccttgtctctcccggttaacattctttgctctcaaggctctttccttcctcatgacaaaactagaagcaaatcgccaaacaaacaggtattccacgaaaagctgaagttttcgacaaaaacacccgcaaaaattgtatgatcctcctcattaatgcaaacgatacttgtgaggaggtgccgtatgaaaacaagaccgaaaaaagccggccagcaaaaaaagactgaatcaaaggcaatcgattctttagataaaaaattaggcggcccgaaccgcccttctacgtaagaagcaaggaatttccttgcttctttattttttcagccactgctccaccgcaaaaagcgcatgaagctggcgctttttatgtaaataccagtctgtcaattcaatctgcttcggcaattcctcgcgcctaaagaacgttttctttatctttccatgaaaccaatctgttttcgttccgtctaatgagtggattaactcagggtagcatgtccttagcataggagatgttctttttgtaatcccgatcatcttttccatatcaaaacgggaacctgtgtgcggcactgtgtgcaaaaagtgataaaaagaggagaacaattctggcttgaacagcaattgagacagctgctttcccagccttatcctttcctccgcctttgaaaagcgtttcactgaaatgccgtaaaaaaacccatttgaggaaggaaaaataacggtgttaaaatgaaaccagtcacttaaataaaaaggaatcgtgtcaaaaacattctttttaaacgaaggattttgtataataggtgtttggatagtgttttgttcatttataatgagggcatacattagccgctccgtatttcgctcatgccaaaaacgggtccattcttccgacataaattgtgagacgccaaacacatgcagcagatgaaacagcggtttcccaactctttttgaccagtggtataaaagaagctgcggataggcatccgaaaaaataagccagttcgctctttcataggctaaaaagaaccatttttgctgtctctcacggagtccaagctgaaacagactgccttttaagtcagtcattgaccagccggcattacgagaaacgaaagaagccaaaagcgaccatttgatttccggatgacggtcgtaaaatgctttataagcatttgttcttgaaatgttatccgcgtttttcatttttgtctgccgctcaatccggctcagaagctttctgatggcctgttgttcttgcacgttcattcacttccgtcatgattagtttaataaggaggatgagaaagtgattcggtatcctaatggaaaaacatttcagccgaaacattcggtttcatcccaaaacagtcagaaaagggccccgtcttacagtaatcgcggaatgaccctcgaagatgacttaaacgaaacgaataagtattatctgacaaaccaaattgccgttatacacaaaaagccgacacctgttcaaattgtaaatgtccattatccaaaaagaagtgccgcagtgattaaagaagcttactttaaacaatcatcgacaacagactacaatgggatttacaaagggcggtatattgattttgaggcgaaagaaacgaaaaacaagacctctttccccctgcagaattttcatgaccatcaaatcgagcatatgaagcaggtaaaggctcaagacggtatttgttttgttattatatccgctttcgaccaggtttattttttggaagccgataagctgttttatttctgggacagaaaagaaaaaaacggcagaaaatcaattcgaaaagatgagttggaagaaacagcttatccgatttctcttggatacgcacccagaattgattatattagtattattgaacagctttatttttcgccatcatctggtgcgaaaggttgattaacgaaaggttgagatgttatgtcagatcaatttaacagccgtgaagctcgacgaaaagcgaacagcaaatcgagtccttcaccgaaaaaaggcaagaaacgaaaaaagggcggattgtttaaaaagacccttttcactttactcattctgtttgttttaggcgtagtcggcggtgctgttacatttgccgtcatggtttctgatgcgccgtcccttgatgaaagcaaattgaagacgccttattcatcaacgatttatgataaaaatggaaaagagatcgccgaagtcggcgccgaaaaacggacctacgtctcgatagatgaaattcccgatgttgtaaaagaagcctttatcgcgacagaagacgctcgtttttatgagcaccacgggattgaccctgtccgtatcggcggtgcattagttgccaactttaaagacggcttcggggctgaaggcggaagtacgatcacccagcaggtcgtcaaaaactcccttctttcacatcagaagacgttgaaacggaaggtgcaggaagtatggctttcgattcagctggagcgcaattactctaaagatgaaattttagaaatgtatttaaaccggatttatttttctcctagagcatacggaatcggaaaagcggcggaagaatttttcggcgttactgatttaagcaaattgactgtcgaacaggctgcgacgcttgcaggaatgccgcagagcccaacagcgtacaacccggtcaaaaacccggataaagcggaaaaacgacggaacatcgtactcagtctgatgaaaaagcaaggatttatttctgattctcaatataacaaagcgaaaaaagtggcagtgaaagacgaaggcgtcgtgtcacagaaggaatatgaaaaagcaagtacaaacaaatacagcgcatttgttgaagaggttatgaaggaaattgatgaaaaatctgatgtcgatccatctgctgacggattaaagatctatacgacattagatacaaaagcacaagataaactagatgaattaatggacggagacaccgtcggatttactgaaggcatgcagggcggtgtgacgcttctcgataccaaaaacggagaagtccgagcgattggtgcgggacgcaatcagcctgtcggaggctttaactatgctactcaaactaaggcacagcctggttcgaccataaaaccgattttggactacggaccagttattgaaaataagaaatggtccacatacgaacaaattgatgactcagcttatacgtattctaacggaaaaccgattcgtgattgggaccgcaaatatctagggcctatctcaatgcgttacgctctggcccaatcaagaaatatacctgctttaaaagcattccaggcagtcggtaaagatactgctgtagactttgcaaatggactcgggcttggtttaacaaaagataatgtaacagaggcctattctattggcggtttcggtgggaacgatggtgtttctcctctgacaatggcaggtgcatacagcgcgtttggaaataacggaacgtataatgaaccgcattttgtaaaatctatcgaatttaacgatggcacgaagcttgacttaacaccaaaatcaaaatcagccatgagtgattatactgcgtttatgattacagatatgctgaaaacagctgtgaagacaggtactggacagcttgcacaagtacctggtgtagaagttgcaggaaaaacaggaacgactaactttgatgataatgaagtcaaaaggtacaatatcgctagcggtggcgcccgagattcttggttcgttggctacacaccgcaatatacagctgccgtctggacgggaatgggagaaaacgaggctggaaagaaatcactttcagctgaagagcaaaaagttgcaaagcgcatcttcgcccagctcatcgccgatgtcgatgacggaagcggatcatttgagaagcctgacagcgtagtggaagccaccgtagaaaaaggttctaatccggcaaaactggcagggccaaatacgccaagcgataagaagctcacagagtactttgttaaaggcacagctccttctactgtttctaaaacatatgagaaagaagaaaaagaggaaacagctaaactgtctggtttaaacgtgaaatacgataaagacaatcaatctttaacgttaagctggaattacgacggagatgcgacctttgctgttaagcaatctgttgacggcggcagctactcggaaattcaaaacagctctgcaaaagaggcagttatttcgggtgtgcagccaggatctgtatacaaattcgaagtaacagccgtcagtgatgatggcaaaagtacagcttccacatcttatgaggtgccaaaagctgaagacgatgaagataaaaaagaccagcaacaaacggatgatgaaaaacaagatgatgagaagaatcaggatgatacacaaactgatgattctcaaaaagatgacggtcagacggatcaagatcagacagatgattcaacaaacgatcaagacaaaaaacaagacaatacgaacaccaatccgtccgacaacaataaccaagaccaatcaaacgataacgataacgacaacagtaacaaccaggatacgtcggatggtgattcgaactctggtaagaatgattcaacaggttctgacacgaataaaaataaaacagacacatctaataaaacacaaacaaactcatcatccattgaaaaaacaaattaaacaaaaaagccgtcacctttggggtgatggcttttttggtacacaataaaaaacctcccgttttaacaggaggttttatcgattcatcgcatgatatttataaaaatgctttttcatttcggtaatcagctcatcaagctgaataaagcaatggtattgggtcggcttaagaagaataaattccactcgttcagcccaattaatcggctttgcgggatatgatttctccctcagttcttgccaatcgagcgatttcaccggctcacctgctgtccaatgtaacgaagccagcaaacacacaatgccctttaacatttcgttttggtcacatctcgattttcgtgtttgaaagactgggagaagtgatgctttgatgtcatcccacacttcaaataaaagcggaacgtatttcccgctgtcctcccatggcaaatcgccttgtaattccgtgcagaaatcaaaatacacgggattggtctgcaaggttttcttcatatccgaggaactcttctggccaagactgcgcaagtattgctcataggaagccaacacttcttttgcttgcgtcatcgtttcaccagtccttttttatccctcttctgcccttctctgcacaaagaaagcagcggacactccgcacagcgcggagattgggctttacagtgatatctgccgaagaaaataagccggtgatgcgtaacggaccagtcttctttgggaaccttgcgcatcagcgtcttttcaacttccagaaccgagtccttccaccggcaaatgcccaatcgtttgctgactctctccacatgggtatctacggctatggccggcacgccaaacgcaacggataccactacgtttgcggtctttctcccgacccctggcagtttgacaagctcatcgcggtctctcggcacttctccgccgtaatcttcaataatcattttactcagcttttgaatatttttcgctttattacgatataaaccgattgatttaatatcctgctgaagctcttccagcggaacagccaaatagtcttccggccgtttatatttttggaataatgttttggtcactctgtttacaagtgcatctgtacattgcgcagataaagcaacagccaccactaattcaaaaggattggaatgaaccagttcacactccgcatgaggaaacatgtcacctatcttgtctaaacagaattcaatttgttttagatttaacacgattgtcaccttttcactttattgttcaagccaattgtaaaaaggaacctgccttttatactctttttgcggttcattctgctttgcttgtacacgccggaatttttggctgtgtatttttgcctgctccacagttttaagcccgtttttcttccattcaaacaaaatccggtcaatgtagcggaaactgagttttcctgatagtacagcctcttttaacgcgtgtttgatcagttgtgcgtcatgctgatcctggtcctgccagatcgccagcgtttcacactccaaaggcgataacggccttgcgaactcttcctcaaaaatggtataaaggcttttttgttccccttctgcttttctttcctgtgtttgattctgtgcaagctgaatatactcgtacagtttcccccataaaggctgaagagaatatttctcaaatttgatgccgttttgatcctcgcattcttcaataaacagaaagcctttttgaataaacatccgcaatctgtttgtgcattcttcaacagaaattgacataccttcctgcagctgattcggtgtaggaaaatatgatcctttttctaaatgcattttaatttttaacagcagaataagttctgtttcattaagcccaagctgtttataatgcgtgagcagaagattggggatggttgatgttccctgctcctgcatatcaataaattgctgttttttcatcgtcacacctcttactgtaaaggattgtgattgcccctttactgtaaaaagtctcccttgcaggagactcttttttgtttcatttgaatgtattacggatacagacggtttaacagtcttgggaacggaatcgtttcacgaacgtgaggcgctccgctgatccaagctactgtccgctctaatccaaggccgaagccggaatgaggaactgatccatattttctaagttcagcataccatttatatgcgtcagaatccagtccatgttctttaagacgcgattccaaaagttccatatcgtgaatccgttcagacccgccgatgatttctccatagccttccggcgcaatcaagtcagcgcaaagcacaacgtcctcacggtcagaagccggctgcatatagaacggttttaaggacgtcggatagcgagtgatgaataccggtttgtcataatgttcagcaatcgctgtttcatgaggcgctccgaaatcatctccccactcgatatcgtcaaagcctttttctttcagaaattcaatcgcttcatcatacgtgattcttgggaacggggctttgatttgctcaagttttgacgtgtctcttcccaatgtgtttaattcaattttacaattcttaagaactgattgtacgatgaaagaaacgtaattttcctgtacttgaaggttttcttcaaattctacaaacgccatttccggttcgatcatccagaattcgattaagtgacgctttgttttagacttttccgctctgaatgtcggtccgaaagagaatacttttcctaaagccattgccgcagcttccatgtagagctggccgctttgagacagatacgcatcttcatcaaagtactttgtcgcaaagagttctgttgtaccttcaggtgcgcttccagtcaaaatcggcggatccacttttacgaagccttcgttattaaagaattcgtaagtcgcgcgaatgatttcattacggattttcatgatcgcatgctggcgctttgaacgcagccataaatgtctgtgatccatcaaaaattccgttccgtgttcttttggtgtaattggataatcggtcgcttcgtgaatgacttcaatatctgtcacagcaagttcatatccaagcggagaacgctcgtcctctttgacaatcccttttatatagagcgacgtttcctgcgtcactgatttagctgtttggaaaatgctttcttccacttccgcttttactacgacaccctgaataaaaccggtaccgtcccgaagctgtaaaaacgcaattttcccgcttgaacgcttattagcgacccaagctccgatcgttacttcctcacctacgtgcttgtacacttggttgattgttgttttcaacatatttccctccaaaacaagaaagacattcggaagctcattgccccgcgaactcttttatcatcactttattatacccgctcttaactaaccgggtcaatgcagataaaaagcggcttttgtgtcagccgctttttgatctgttagctatgtttttctacaaaacgcttgattctttcaatggctttttcaagaagatctaacgatgttgcataagaaagacggacattctcaggagagccaaatccggatcctggaacaatcgcaactttttcctcctcgagaagcgctttaacaaattcatctacatctttgaaaccgcaagattgagctgcctcttttgcatttgggaacaagtaaaaagcaccttccggcttcacacagctgaaccctgggatttctataagctttgcatagatcgtatttaatctatgttcaaatgcttctctcatttcttccaatggctcagaaggcccgttataagcagcaatcgctccgtattgtgcgattgatgtcgggtttgacgtgctgtggcttgcaaggttcgtcatcgctttaataatgtcttcagagcctgccgcataaccgattctccagcctgtcatgctgtgggacttcgatacgccgtttataatgaccgtttgctctttcagtctgtctgacagctgtgcaatggaaacatgtttctttccgccgtatgtaagtttttcataaatttcatctgacacaatcaagatatcatgttcaaggcacacttcaccgagcgcagatagttcttcttccgtatacatgacaccagtcgggttgcttggagagttaataacgattgcttttgttttttccgtaattgcatttttcagctgctcaggcgaaattttgaagtgattttcctcaagcccttctacataaacaggctttccgccagcgagtttcacctgctccgggtagcttacccagtaaggcgttggaataataacttcatcttcttcatccaaaatcacttggaaaagggtatacagagcatgtttggcaccagtgcagacaataatttgagacggtttgtattcaatattctggtcgcgtttaaatttctctgcaatgctgtttttcagttcagccaaaccaccggaaggcgtgtatttcgtatggccctcgttcatcgaacgcacagcggcatcaataatatgctgcggtgtattgaagtcaggctcgcctgctcctaagccgatgacatcatggcctgcggctttcagttctttcgctttcgctgtgattgccagtgtggttgatggtgttaatgcggatactctttttgccagtttcaacttgaactccccctaattcgtcttaaggcgtgatatttttgagaatctttccagttgtaaagtccacataacttaaactgtattgcccttctttgtctaagtacgtcacttcccaaagcaggacgtttccttctcttgccagatgaacctctttttgctttgaaaccagcccttcatcctttatgattttcgccgctttgtcttcagagattccctctttcgcttcttttgagagaatttttgcttttttatcagcaggaacccagacatataacgcagtgccttttttatccgttccctttacaacataatatttttcttttccgacaaatgtttcgacttgatcaacattggcgagatcggtttcttttttagcttcagcagctgctgcttcgtgcccctcttccttttgtgccatggctgatttataaatgcttgccgagacaagaagtactgctaaaaaaataataccaaaaatgacggtaaatattaatgctttttttctcatcttctcacctacgtacgataaatggtaaaaacggcttggtttttgttttcttcatccagcgcaaggccgaacatcagattgtctcttttcagtgtacgattcaatgtgtccacaattttatacagatcatcagaatgctctacattaattgttgaaagaatttcgattttactttccattttttcatcctccagtttgaacaaatattgttagtcatactccatttcaggacacgccatactagtatcacagagcgggaaatccgcttttaaataaaacaccatcctactcccacaccgcaaaagccgctttatgcggcttttattctttttcccctgcaacataagcttcaagctcgctgtcagtcatttcggatactgaggttgtcggcaaggcatcaagaaacagccggccgtaaccagcggttttaatccgtctgtccaatatcataatcgttcccttgtctcccgcagaacgcagcaagcgtccgattccttgcctgaaggtcagcacagcttccggtaatgacactgtttgaaacggattctttccttttttgcgggctagctcacattttgcagcatgaagcgggtgatcaggggaccggaatgggagcctcacgatcattactgttgtcagctcatcaccagggaaatcaacgccttcccaaaaatgatttgttccgagcaggatcgcctgattggatgttttaaaagtcttcatcagtttgccgggactcccgcctgtaatcccttgtgccaagagctgaatgccggaagcactcatgttatgcttgagctcctggtgaacctttttcagcatatcatgggatgtaaacagcacaaggattttaggctgtttttcctttgccatcagttcgatataacgggctgtatcctgtataaattcaggttgcccggtatcctgaattgatttcatttcctttggaatcattacctgcatacgctcatcgtaagaaaaaggtgactcaattctcattgtccgcgggaaaaagtcactcagtcccagtcgttcaatcataaattgaaaagaaccttcgactgtaagggttgcagatgtcagcaccacactatttttgcgcgcgaaaaactgatcagccagaagttcaccaggttcaagaggctgtgcgtaaatggccactgcatttttcgcaccctttgcatctatttcaatccaaaccgcttcatcgtcatcagacccaaagaagagcttctgcaacgtctgacagtaatgctgcaagcctttcatgcttctttggtattcatcggctaaaaagacggttttgctcttcatacccttcaaatgtttttccataagggatgactgcgcctcaaaaagctgctgcaaatgtgtcagcatggaacaaagcctctccgcaccatctgttaagatcgaccagcttttatcctggctttctttgttcaccttaaacactagacggtttaagtcttctttaggttttcttcgtttgacaaaagaatgtacagagctgaagaaagcatcactttctgcttgaacgtgctgaagccactcttccaattcgaaaaatgaatcaaccggcaggctgtttcgctggaatagctgtctcatcttttttagaagtccctgctccttcagagtgccgattctgctcaatttcgtatgcaattctatgtacgtagctcttttccctaaatgttcgcttgccgcacgttcaaaatggtgtgcttcatcaataataaatgtgccgctttcgggaagcctttttttctggctgccttcatcggtcagcaaaagagaatgattggtgatcaccaaatcggaacgcaaagcaatctgtttggcccgctcgtaaaaaccgatcacatgctcactgcgacttcttttataggagtcatcgtcataagccaatctgtcccacagcaattttccgcctgaaggcaaattcagttccgctacatctcctgtatttgtctctgtcagccaaacgagaagctgtgcctttgtcagtacggcatcataattatcatcttcttcatgaagcacctgctcaaatttatacaggcataaataatgcgattgcccttttaaaatcgccgctgttaccggaaatggaaacagatcttggacaatcggcaaatcctttgtgagaatctgctgctgtaaaagcgtcgaatacgtgctgattatgaccggcttttttgatttcttggcaaaaagcgcagccggaataagatagccaatcgtttttccgatgcctggaggagcttcaatcagcgcatgctcacgattggcaaacgcatcagccacctctctcatcatcatcatttggccgtctcttttttcatacccaggcattaactctgacagcgctttttcatttcccgcttcccagctttcgatctcaaatgagaagttctcgtcctcatttatacgaacatcgatagcttcaggttctctgacagaaaacgaagaaaagcgcgtatagcccggtatctcggtatgtctgttttcattaatgaacatatccaacaaatgcgtcagatcactgatgaaatgctgcgaaagccttcttaactgctttaatgtcggataaggaagctgccgcagcttttcaaggatttccaaaaaaataagccctgtcacttcagcatcgctgtcagcccggtgcggctgatcatgccgcagctgaagctcctcgcttaattccgtcagcttatacccttcaaatcccggaaaaacaatacgtgagagctcgacagtatcaagcacttcacaatctgggagctgaaagcccgccttatgtagctcatacttgacaaatccaaggtcaaaatggatattgtgtgcgacaaaataagcgccgtcaagcaattggaatacttcttcagcaactgcttcaaatggctgttcattctcgaccatttgattagagattccagtaagctgctcaataaaagcagggattgatttatttggattaatgtattttgaaaaccgctcagtaatttgtccattttcgattacaaccgctgcgatttgtatgattttatcgcctttcttcggcgaattccctgttgtctctacatctataacaacgaaccgttgcttattcattaaaatggacacctcaattcttgcatacgacaaaagtgtaacacgttttgtacggaaatggagcggcaaaaccgttttactctcaaaatcttaaaagaaaacccccgataaagggggcttttcttctacaaaattgtacgggctggttcgttccccagcatttgttcaattttgttttgatcattcagaacagccactttcggctcgtggcttgccgcttcttgatcagacatcattttgtaggaaataataatgaccttatctccttcctgcacaaggcgtgcggctgcaccgtttaagcatatgacgccgcttccccgtttaccaggaataatatacgtttcaagacgtgctccattattattattcacaatttgtactttttcattaggaagcattcccacagcatcaatgagatcttcatcaattgtaatgcttcccacatagttcaggtttgcttccgtaacagttgccctgtgaagcttgccgctcatcattgttcgatacatattatattctctccatttctcgaatatcaataatgatattatctattaaacgcgcttttgaaaaagcaactgcaacagcgagaatcatctttccagcaatttcattcacaggctcgagttccggataggaataaagctctacatagtctatggttccgctagtcgtttcaatgatttcttttgcagcttttatcaccgcttcaggatctctttcaccggcttggatcagctccgcacttgtttgaagggcccgatacagcttaggcgcttcttttctttcctcagctgttaagtatacattgcgagagcttttagctaagccgtcttcctctctgaccgtatcgacaggaaccaattcaatatccatgaagaagtcactgattaacccatcaacaacagctacctgctgcgcatcctttaaaccgaaataggcacgagtcggcttgactaggttgaaaagcttcgtcagtacgatcgcgaccccgtcaaaatgtccttctcttgagcgcccgcataacacgtctgtgcgtctttctacatgaatcgtgacattcttttcaccgggatacatatcatgagcatctggcgtaaataaaatatcgactccggcgttttctgcaagagctgcatcccgctcaatatcgcgcggatatgcttcaaaatcttcattagggccgaattgtgcaggattcacaaaaatactcataataacggcgtcgttttcttgtcttgctttgtctgctaaggttaaatgcccctcatgcagaaaccccatcgtcggaacaaatccgattgacttgccctctgaatgatattgttttatggcttctttcagctgtgtaatatcagtaatctgtctcatcttattttcccccgtacaagccgtccagcactgtctggttcatttgaaaggaatgcttttgttcagggaaagcacgatgtcttacatcctgaacatatccgctgattgctgtttcgatggtttcatcaatacgcgtatattgctttacaaatttaggtgttctctcaacaccgtggccgataatatcatgataaacgagaacttgtccgtctgctttcacacccgccccgattccaatgaccggtatgcttagcgtatcggcaattttggctgtgagttctgccggtacacattccagcacaagcatcatagctcctgcttcttcgcattttatactgtcttctattaattttttggcgctttgttcgtctttgccctgtactttatagccgcccagtacgccgactgactgcggtgtcaaacctaagtgactgactactggaatgcctccaagcgtcaatgcgcgaatggattcaaacacgccttctccgccctcaagcttcagtgcgtcagctccgctttcctgaacgatagccgctgcatttttcagcgtatcttccttggacaggtgataagacataaacggcatatctgtcacaataaaggtattcggcgcaccccttttaacggcttttgtatgatgaatcatatccgcaactgtcacacccacagttgaatcaaggccgaggacgaccattccgagtgaatcaccgactaaaatcatgtcaactcccgcttgttcagcaagtttagctgccggataatcataagcggtcagcatgacaatcggttcttcagactccttcatttttagaaaatccagttttgttttcatgttttctcctcctcatgtttagaggagatgatctgccgtttcttctgcaagccaaaaaaccttccgttacaacgagaaggattcttcactttctaaagttcggcgagtttcatccctctgtcccagtccttttttggatcaaggcagactgctgcaatgtctatctattttaataataggtgcagttcgcaggcgatactgcccaatggaagtataccaaaatcaacgggcttgtaccaacacattagcccaattcgatatcggcagaatagatttttttaatgccttcgttcgtttctaaaagcagaacgccttcatcatctatacctaacgccttcccgtaaaaggttccgtttaacgttctggctctcatattagtgccaataccgagcgcatagctttcccataaaagcttaatcggcgtaaatccgtgcgtcatataatcccggtaccgtttctcaaagcatagtaaaatatgctggatgacgccggcccgatcaattttttccccagcagcttggctgaggcttgtcgcgatgtccttcaattcatctggaaaatcattaggctgctggttaacgttaatgccgatcccaatgatcactgaacgtacgcggtcttcttcagcctgcatttccgttaggatgccgactgttttttttccgttaatcaaaatatcatttggccatttaatatccgtttggatgcctgctgcctcttctattccctgcacaacagctactgcagcaagcagagtcagctgcggtgttttttggagcggaatgtcaggccgcaaaatcaggctcatccaaacgccgtttccttcttgagaatgccataccctagacattcggccccttccggctgtttgtttgtcagccaccacgagggtgccttccggtgagttattattcgcgagctcatgagccgttttttgcgtgcttgaaagaacgtcatggtaaataagatgctggcccatcacttccgtttttaatccaaaacgaatttcgctttcactgagttttccgggctttttgatgagccgatatccttttcttctaacggcttctacttcataaccctctttccgaagctcttcaatatgcttccacacagcagttcttgaacagccgagagcatcactgattttttggccggaaataaattcattgccggcctgagaaaataattcaattaggtcttttcttaatgttgaccgcatgtcttcagccactcctctatgtgtttcttttgattggagagcttccctgtcacaacagcctgctcgatccgctgtaattcttccgacacccattttccggccggccggtttcgaagcgcaagcaagtccttacccgtgatatcaagatccttaaggcttttgatcggcaggttttgataagtgtactgaatgtccttcagtttcttttcatccagtttttcgttttgccgaagctgcgatattttggccgctgagagcagtgctttttccccagctctgtacattgtcattgcgtcaaggctctggccaaacgtatcggcaatgtgaatggcttccttgaacacttttcccgggagcttccaggctttcaggaaaaggggcgcgtctttcaaaactatgccaaggttaattaaaagagcagcccaaagctcctcacgggatgttaaagagaagaatggaaactcactcgttgaaatcaggttttctcgtttatgataaaaaccaggaagctcttcatacaatctcgtttgaatgagtgtttgaagcgcctggcgagaagctcttccctgcagcaatttctcgaactctatagtttttcgttcgactgaaacatgggagaggagtgatttttctttcgcaatggcttcttctgtttccggtgaaagcgtaaagccaagctggctcataaagcgtacggctctcagcatacgaagcgcatcctcttgaaatctatcctcaggctttccaacggttcgaatcactttctgatcaatatctttcttgccgccaaaataatcaagcaccttcccgtccgctgtcatggccatagcattgatcgttaaatctctgcgttttagatcctcttctaatgatgagataaattgcacttctgacggtcttctgaaatcaacataatcagattcagtccggaatgtcgtgacttcataggtttcatcctcccagagcacaataatggtcccgtgctctttgcctacatcaacagtccgctgaaacagccgttctacttgatcaggtgccgcatctgtcgcgatatcgacatctccgatcgctcgtttcatatagctgtcacgaactgcgcccccgacaaaataagcctgatggcctgcttcgattaagatgcggagcacgggaagtgctttgataaaaactttttccatgtgatcactccggttctgctaaatcggcataaatctgttcatactggctgacaatttttttggaagaaaattcattttcaagcatctctattgccgcctttgtaaaacgattgcttagctgttcatcttctaaaatgctcatcgcgcgggctgttgctgccgcaacatcaccgacatccaccaaaaatccgctcacattgtttttaataacctcagggataccgccaatgtttgttccgatacaaggcactccgcaagccatcgcttcaagcaggacaaggccaaagctttctttttcagatagcagtagcttcaaatcgctaatagaataaagctcttcaacacggtcttgatttccaagcattaagacttggtcttccaagccatattttctgataagctcgcaggctgtcgatttctccggaccgtctccgactaaaagcagcttcgctttcgttttgccagcgatattgcggaacacacggatgacatcctgcacgcgtttaacttttctgaagttggacacatggatgacgactttttcatctggtaaaattccatgtttctctttaattgccgctgtgtttttcttcagatacacgcgctcgtctataaagttataaatcgtttcaatttttttctccggtttaattaaatcgtatgtttcagccgcaagcgctgaggagacggccgtcaccctgtctgatgactcaatagcaaaacggatcagatcttttagagacggatcataacctaacaccgtgatatccgtgccatgcaaagtggtaacaatgccgatattgcgtttcagcatttgttttgcaagataggcgcaaacggcatgcgggagagcatagtgagcatggataatgtctaaattctcccgttccgccacctctgcgattttgcttgccaatgtcaaatcatacggaggatacttaaaaacagcatattgattaacctcaacttcatgaaaatgaatattgggatgatatgtattcagtctaaacggaatgcttgatgtgatgaaatggatttcatgtcccttttcagcaagctgcttccccagttctgtcgcaatgatacctgagcctccaacgctcggatagcatgtgattcctatttttagttttctcattgttcgcccccaagcacatcatgatcaagcatcagcatccgttttgaaaagaaaccttcggcatactccacgcccgcttctttaccgtaaagcttttctctcgcttcaacgatttcaatatacccattcgtcagaggagtagaaacggaatcctttgacgggataaactggcttttgtaggcgttgaggctttgtttctttgcctctattgtatccgagatatcaataacaaaatccggctgatgaaaaccatttatcatataatagtaaaccttgctgactttatgcgccggaaggcttttttcgtctttatatttatggattccggcggaaaagatcgcttcttccaccagtgcagccgcattgccgtgatccggatggcgatcctttttatacggcataaaaaccgcttttgggcggcaggttctgatgatagtgacaatcgaccgaattgcctgatcactcattattaggccgcggtctggaagcgttagctgaattcttttatctgcgcctaatatgcgggctgcttcagctgcttcttctttacgcaaactgaccgtaccgttagaagagagttccgcttctgtcaaatcgcatatcattacttttttttcctgtttgacaaacttcgctattgtgccgcccattccgatctcgacatcatcactgtgggcgccaaaagcaagaacgtcagcattatacattcggctcttctccccgaagaaggtcacggaattcgaaaacaccttcatcaagtgtgcggacgagaatttccgcagtacccatatttgtggcgagcggaatggaatacacatcacataaccggattaatgccgagacatccggttcatgcggctgcgcggtcagcgggtcgcgcaaaaaaatgacaagatcgagtgcattggcagcgatcagtgcaccgatttgctgatctccccctaaagggccggattgaaaacgttcaatttgaagacctgtcgcctcttgaattttcaaccctgtggttccggttgcgtatagatcatgattctttaaaatatcctgataggcagtcgtaaattgaaccatatcctgttttttcttgtcatgcgcgatcaaagcaattttcattgtttatccccccgtctaatcaatgatattttctaaaccgtacacaagctgatcaatcttcatgacttgttcgactgacagtttaacgcctgacatgaaagaagcgcggttataagaatcatggcgtatctgaagcgtttggccatccatgccgaacatgacctcctgatgcgcgatcagtcccggaagacggacgctgtgcaaccgaatgccgttttgctccgctcctcttgctcctgggagaatttctttttcatccggatgtccttgctgcttttctttacggacttctgaaatcatttccgctgttttaagcgcagttccgcttggtgcgtcaagcttctggtcatgatgaagctcaataatctcaacatcctcaaaatagttggcagccatttttgaaaatttcatcatcagtatcgcaccgagcgcaaaatttggcgcgatgatggctccgatccctttttcttctgttaaagatgtgagctcttttaaatcagcttctgagaaaccggttgttccgacaactggacggactccgtgctctaatgcaatttttgtatgtacttttccgatttcgggcgttgttaaatcaatcaagacatccggttgtgtttctgtaaagcaggcatggatatctgtgtaaatgaaagcatctgactcaacaggcatcacatcagataatttttgctgatcgtatgtatggtctatggccccgacaaggtcaaaatgaggtgttcgttctgccaatttaacagcttcctgccccattcttccacgcggtcccgcaatgactactttaattgtttcgtttgacatcttgatctcctctactttccttcttcttttctggtccagcgatctttatctcttgtattaaatttatgcatgactcggtcgtgagcttcctctaaagagatatcaagagagttggctaaacaaaccaatacaaatagcacatcgcccatttcctcttccatgcttttatcatcttcagtcgctttttttggtttttctccataacggtgattcacttctctggcgagctcgcccagttcttcagtcagcctcgccatcatggccagcgggctaaaatatccttctttaaattggccgatgtaacggtctacttcagcctgtatgtctttcattgttttatcactcactgaacgaaacctcctatcatcctcttacatgttagctaattcagatacgtttgacaaatgtttaagcacgtttgctgttttctttttcatccactataatataaacgctatctaatggaaggaaaaggggttttgtgtgatgcttggagaaattagattaaaaaacatattttttattttaatcggagcggcaattttttcatttggcttggttcatttcaatatgcagaacaatctggctgagggcggttttacaggtattacacttttgctttatgcccttttccacatcagcccctctatctcgaacctggtattgaacatcccgattttttttattggctggcgtttgctcggcaggacaatgtttgtttatacccttgtcggcactgtagccttgtctttgttcctcagcatctttcagcgatatgaaatccatatgccccttcagcacgacttagcgctcgccgctttatttgccggcgtattcatcggagccggactgggtattatttttaagttcggcggtacgacaggcggtgttgatatcatcgcacgtttagtgaataagtattttgggatcccgatgggcagaacgatgtttgctttcgatgcctgcgtcatcattttgtctttgcttacttatctctcctataaagaagcgatgtatacgctggtagctgtatttgtagcggcaagattaatcgattttattcaggaaggcggatacgctgctaaaggcgctacgatcatctcctcgaaaaacgacctgattcagaaaaagattcttgaagaaatggaacgtggcgtcaccattttgaaaggacaaggttcctacacaaaagaggatatagatgtactttattgtgtggtgccgaaaaacgaattggtgatgctgaaaagcgtgattaactccattgatccccatgcctttgtagcggtaagcgatgttcacgatgtgctcggagaaggatttacgcttgatgaaaataaaaatccgcttccgcgctgacatgtaatagaaaaaaggcggctgaccgccgcccctcatccttatttagggtagtccctttttttcagcttgtttttttccgccttgtactttctgtaaccgacataggtaagagcagtaatgatgatactgccggttgtaatcatcacccagagtaaagacggatcggcatcatcctcctccaccctgtcaaacacatttttcaggtcatgctgaagaagggaaagccgttcaagcttcgtgctctctgtcatttgctgaaattcctcttgctcaataacgtctatatgttttccgactgtttcaagctgatcctctgatacatcgattgtaagactggggtaaatcaagtcatataaactgataaattcattccatttttcatgaaagcttgtgcttccattcttttggacatctcgcttcagttcagtaaaagcttccataatcggtttttccagtgagccccaaagcgggtcagaccgattttcaaccgcatccatcagcatcctgaactgcgcggctgctctgagtttttgtgtgtctgatgtatcagcttgctttaaactccgaaccatatcattatagcccaatgtgatttgacggatttgggatcccgttagcatggggtcttgctgttttttctcagcggattttaatgttttttcaaaatactccaagacttgaagcgcctcttcatattttgcctgtcgggtcatttgaaagactgtatcggataaatcattcaattcctcgaggcttccccgctctgcagccttggcatttccattataaaaaataagtgcaatcaacaaacagatcgtcagctttcgtttcatgcaggtccctcccactctctctccttacagaatatgaagaaagggacaaggatagaccaacattgtctttacatcagctcaagcttcgtttgcttttttgagaccacaagaaagtaagcaagcgcgattgagaagatgcttagccaaaatgttccgtatcctatttcagtcatataatcagaaagcattgaataccgcggcatcatatcaaacaagtagtcaatgacatcgttatgcagtgtccagactgcagcaattgcaagatgccaaaatgaaaaacgaaaatacggactgtataatacgccttgaacagccattgcaaaatgcgaagcaattagcatgtagccctcccacggcaagtcaccagttactgcaagcacaagaaaattcatagccaccgcccataggccatactttacgagggtaactagcgcaagcgcctcaaagagcggagcattccgtttcatgagaaaggcaagcagcacaaacagaaagaaaaacgttgctgtcggactgtccggaacaaaaatcaggaaacgggccggtgtctccaaaagctgcggcaagtaccaatagtagccgtaaaccgttcccagaaaattaatggctaagacaagaataagcatcggccgctgccctaatacatattgaaaccatttcacatcgaatcaactctcagtctgtaaaaataatatgtccaaataaaaaagctgacgccgggtcagcttttgataataaaagtatatccttccatttgacaattcacaatacgttattttgcggttgtttcagaaataaattttgcaagttcttcgagttgcttatcatttcctttgaacacacccgccggcattttgcctttcccttctacagctatttttttgatttcatccggtttcagcccgctgtcaaccaatgaaggcccggccgctcctccctgaaggttatccccatggcaagaaatacagccctgttccttaaagaccttatatccttctgcattggtgtcaatgtcggcttcttttgtgattttcccctgttcttctgccttggcccagtcatgagtagcaactgactgccacgtcaaaaatacagcagcggaaatggccagaagcatcataccgacagcgaccggacgcttccacggccttctttctgtccctctgtctaggaatggagccaaaagcagggccccaaaagcgagacctggcataatcatggcgccgaccactgtaaagcttccggcggcgtattcatacttcaacagctggtataagaaaagaaaataccaatccggcagcggaatataaccagtatcagtcgggtccgccatccgctccaaaggcggctgatgcacaatcgtcaaaacgagaaaaccgatgagaaagacagctccaaccatccattcctttaacaagaaatttggccagaaagcctctgttttaccgggatactccgaataatccttcggtatattcggctttttttcagccggtatccttgagtcgcctacaaatttcatccctttgccccggtgcatgtcatcccctcccttttattcgcagatcaagagtttaaagcggtcctgaaatcccctgcttccggatcataataaaatgtgcagccatcagcccgaacaatgcggcaggaagaaaaaatacatggatcgcaaaaaacctagtcagcgtttgggcgcctacaatatccggatgccctgcaaggagcgttttaacttgcgttccgatcaaaggcgtggcttcggcgatctgcagcccgacttttgttgcaaacagagccttcatatcccaaggaagcaagtagcctgtaaagccaagaccgagcataacaaaaaagatcagcacaccgacaatccagttcagctcgcgcggttttttatacgcaccttggaaaaagaccctcagcgtatgtaaaaacatcatcacaatgaccaggctcgcaccccagtggtgcatccccctgacaatctggccgaatgccacttcattttgcaaataatataccgattcccaggcatttttgatatcaggcacataatacatcgttaaaaacattccagataatacttggataacggttacaaaaaacgtcagtcccccaaagcaatacacaaacgcagagaaatgatgggcgggattcacatgttccggtacttcgtgatcggcaatatccctccacatcggtgtaatatcaagccgctcgtctacccagtcataaattttgttcagcatgtcacccttcccccttaggctttgcttttccaagatacaggaagccgtcttttacttcttgctcataatgatcaagaggcgcaagcggcggcgtgccagggacattggtgccgtccttttcatagagtccgtaatggcatggacaaaagaatttattcgggtttttaggatcactattccagttcaccgtacaccctaaatgtttacaaattggcgaaagtgctacaatttcatccccgtttttgaagacccaggctgatcttgactcttctgactcataccaggcatcgacttgattaattttaaaatcaaagcgctgcggctcttttgtcaactcatcaacgctgacaacctgaaccatatcctgcttccctgtcgattttaataccgggtcgagtgcgaagcgaaccataggcatgagcatactagccgccataaaacctcctacgcctgtgagcgtgtaattcaaaaattgacgtctggatatatcatgttttccgcccatctcttctcccccctctaggtcacccctgcaaactgactaaaatagaaaatattgcaataactctagacaccctcataatatatgaatctctcagcaaggtcaatatagccaaaatattgttcataaggaaatgtaagtgtttttatgaagtgctccataactgtaacaaaacgttcaaaatttcagcagtgcgttcatccaatatttttctttttaaagagtcatttaaatgctctaatggaacagacggtgtaacaatcattttgcctaacgcatcctcagctctccaactttcgtcagatgtgagcaggacaacatgcggaaattccgttatcagctcttcccgcaaatccttaagcccttgaacggttatttcatttctatcaacatatgtataaggcggaagtaaatatacccgtccctttaactgcctttcaagttcttctgagagaagctgcgtaaactcgcctttctccgccgccattttaaaatggttattaacccttatgttaattaatggtatgacagcggtatcaatgtaatccttagcttgtaaatagtccttggcatcagtgattctccacctcatcgttctccccctttacggcaacaagccttgcaattcactgcaaggctggtcatattatgtgagctgatttaattggcgcgataattgttcaaatgcctctttatcatgacgatctaacgcgtcgtcaatgtcttttaataatttttctctttggaatgtggaaatagcgtgctctaaaatctgttccgccaatccctgatcttttttattctcaaaaaggtttttcggaatatgcgggttggactccagcaccgccgcatattcaggtgagctgtaagccgaacggaaattaagctggataaacaaatcctgctgtttatttaatctaatatcatgaaaagatttttccgcgtcggtagtcatgacattctctttatagaaccggaacggaacttcttcaacacaatgtgttgacattataatgcctctcgggcaaaattcagcctgctccacaaaatgaaccttctccatgagagaatcatggctcattaagtagttcaagatccaaacgcactctcggcgctttaactgataatggtttaaaaaccaacggataaaatcttttttctcattgacagaaacaggggtctgcatgtaattccctcctctatcgttcgtataatctatatacttatatgttccacatgaatggttaatattcctgcttatctagaaaattcatcctcgattcgcaaaatcgtttcttcaagctcttcattggctccgtccatttcaagaacctttttcaaaagcggcagcgcttctttttgaaggccttcttctaataggaagcttgcgtattcatataagaaatctctatcctcccgataatgaagataggcagcctcaaaggattgttttgcttcctcgtattgctctaattcagtatatgcgcttgcaagataccaattgtatttcggatcttcttcaccgtagcttcgaacctcttgaataagatcaatgatctgatcataatcctcttctttgtgatacacggcaagaagtgtatgaagcgcctcgacaaagcccggatcaagcgcaagcgcctcctgaagcagctttttcccctcttctgacttcccgattttcaaggccattttggcggcataaaggaaaagttctttgttatattcatcatatctgatcccctcttttgccgtttttaatgcctcttcatacaccccttcagcttcatagcttttcgagagcggcatataaagtgaagtataagatggatcaagctcctttaaatcagacagctgcttaatagctgttttcacaagccccgcctgtaaggctgtaaaaccatagccgaaaatcgtattaggatcaggattctcatcgacagctttctcataccatggaatggcatcctcaaattcacctgaggcacttaacgattctgccagtctttgatggacattaacgcctccgatctcactctgctcctcagccgttgttttaaaatattgaaccgcttttgcataggctccctgagcaaagtaaagttctcccagtgcaaaatcaataacaggttcattgtccagaatggactttgcctgtaaaagcttttgttcactgacttcgaataacccctgcatctgataaagatccgccataagcagcaaactttccggatatgatggatctgtttccggaatagtctccagcacagcgagggctttttcttcttcgtcaatatctattaaaagttcagcgtagaaattcgtcagttctgtttcatttggatataaatcatgtagatcactaatcagtgaaattgctttttctacatcgccccactcgtaataaagctgggctgcaatggctttatcttcatcatgcagctgtttttcagccttcgagagcgtgttgaggcctttttctgtttcacctgcttcaactaattttatggcttcttgaatcaatgtattcaaatcggaccggtcctttctattcctatacaacatcaaccatacaaaaaagctttatttgttcaggttaatcttatcataattcagacgaatgcccccggcaaataagatgcttctgtacggaagggaattattgagtcttattagtttaccaaaagatcttgagatagaaaatgaaaaaaggaagatcgccctctgtacagtaaagcagctctttgacctgccggcttgtaagtaaagcacatcccccctttttgtttttctatcccctctataagacaagctatgttttttcgcctcgaattatgatctgcataaaaaatcctgaagtaaaacttcaggattttttcgaaagcttatttaaatgctcgaagaaggttggataagaaacgtgaatggcatccgtgtgctcgatttcaatcggctcctccgttatacaggaagcaataccaagcatcattccgattcgatgatctccgtggctggacactgccgcgccgcctttcaacgtttgtttaccataaaccttcattccatctgctgtcggttcaatttcagcacccagcttgcgaagctcagaaacaacagtatcaatacggtttgtttctttcacttttagctctgccgcgtccttaataacggtagttccttccgcctgagtcgcaagaagcgcgatgatagggatctcatcaattaaacgcggaatgatatctcctccgatttcaactgcttttagagatgacgtttctataatcaaatctccataaggctctgcaccgctatcagcagatggtttgatttcaagttttgcccccatgttttgaaggacgtcaataatacctgtccgagtcggatttaaacctacgtttttcaatacaattctgctgtttggaaccatcgcgccagcagcaaggaaaaacgcggctgaagaaatgtctccaggaacaaaaatatcagcagctgtcagtttctggccaccagcaatggaaacactcgtttgatcttcagaaagcttaacgccaaaagcagaaagcatccgctcagtgtggtcccgagatttatggggctctgtgacagttgttgtgccctcagcctgtaatccggccaacaaaacagcagatttaatttgcgcgcttgcaacaggtgatacataatcaattccttttaatgaagcgccgctcactgacagcggtgtaaactctccgccggctctgccgtcgattttagcccccatttttttcaaaggctcagtcacacgcttcattgggcgcttcgcaatgctctcatctccggctaccgcgctgtaaaaaggacggcccgccaatattccgagcatcaggcgaatcgttgtacctgaatttccgacatctaaaaggctttctggctctttcagggcatcgattccttttccgtgaatcacgacatcgctgccgctttgctcaatgtgaacacccatttttctaaagcaatcgatcgtgctcagacaatctgctcccggcagaaagtttttaacagttgttgtgcctgccgctagcgcgccaaacataacagagcggtgagaaatggatttatcaccgggaatatgtatttctccatgtaaggcctgcaccttttctcgtttcattttttccacctcaatcagcataaaaagtttcatattccgcccgggcttcaatgcattgttctgcccttttgcggtcgtcatcagactgaaaactgatccttaaaatcccgttaatatcctctcgtgtttcgataatgcggatattcgtgatactgatgcgctccgcagctaagatcgctgttatctcggatattacacccggatgatcgggtacatccacatataaatcataaaatgcaggtatcgctcccttctgccgaagcggcagcccgtcgcgataatccttggcggttttaaaataacgaaatagattttccgcatcttcttgttctacatatgtacggatcttgtcaatttcacgaatccactcatcaaaacggtctaagattttatctttattatgtaataaaatatcccgccacattgccgggctgcttgatgcaatccttgtaatatctctgaatccgccggcagcaaaacgcttaacaagcggatacaggttttccgaatgatgggtttggtgaacaagactggctgctacaatatgcggaaaatgactgattacacttgtaacgccatcatgctcctctggcgacatttccacaaaatgggcattcgtccccttcagcaggttttttaactgttccacagcttgtttgtccgttttctggcctggcgttaaaatataaaatgcattttcaaacaggaactccttcgcagcggccactcccgatttatgtgaacccgccatcggatgccctccgacaaattgatagcggctaggcagcacttgatcagcgtaatcaaccactttttgctttgtgcttcctacatccgtaatcaaaagctcatgttcaattcctgaatgagccagctcttcaagcataaccagtgtttgttcaacaggtgtcgcaatgattactgtagctgcctctttcgcaccgctaataaacgaatcagcacgatcgtctatcacgcctaattttaatgccgctaccgcctgttcatcagagatatcgattccgataatccgtttgccgggatgattttttttgatggctagggcaatcgaaccgcctatcaatccgagaccggcgagcaatattgtatctttcatttgattcatacgtcatcacctggtttatagactaaagaggtgatattcgatcacctcttataaaatttcagctaaaatggcaagtatttcttcattttgctcttttgttccgatcgtaatccggagtgatgtcgggaaacctaatgcatttcctgaccggacgatatagcctttttccagcagagcctgaaacagttcatcagcaggacgtttaaagtcaattaacacaaaatttgtctgtgaagggtagcactttaaaccatgagttttcgcaaaatcataatactgctgaaggcctgcattattttgctcgacacaggaagcaataaacgcttgatcatcaagtgcggcaatcgccgcagcctggcccagacggctcgtattaaacggctctctcgccggctcaatctggcgaatcaggttctcgtcagcaattccgtatccgactctgagcgctgccagaccgtatgcctttgaaaatgtgcgcaaaatcatcaaattggaatacttgcttaagagcggcacggtttccgggtaatcctctgctgttacatattcataatatgcttcgtcaagaacaacaaggacacgtgaaggaacgcgctccagaaatgcgagtaattctccttcagatgtataagtgccagtcggattattcgggctgcatatccaaacgacttgtgtctgttcgtcgatggcttctaacatggcgtctaaatcatgtgagccgtcgggacgaagtgcaatttcacgcacttcagcaccttcaataaccgcattatgtttatattgcggaaaagtcggggcagcagtgatcgtattggttttattgtttagaaatgcccggcagatgatctgaatgatttcatcagaaccgttgccgaaaataagtgatgtttcgctgacattgaggtgcttactgagccttgtccgcaaagcggcgctatacccgtccgggtaaagggctagctgttgaatctcatgatgaagcgcctcttttgcagcctctgaacagccgtaaggattctcgtttgaagcaagcttcacaactttatccaagccatattctgatttcactgcttcaatcggctttccaggctgataaggcttcagctgttttaaatgttctttgatacgcaaatcagtcacctcattttaaactgtacaagccgctaaacgccattgcataatcctcaaactcctgcagcgcctgatttctcgtttcagcgctgatgagccggtcctttaattcttctatttttctgacgagcgcacttcccactacgacaccgtcactaatttcattcatctttatgacctgttcacggtttgatataccgaaccctacagcgaccggaacagtgctgagattcttcactgtccgaatgaacgggtacacggatgaattgaactcattgcggacaccggtcacacccagagaagacacacagtagacgaagccctcggcttgttcaataatggttttcaaacggctttcgcttgtcggcgcaaccaaagaaatatacgtcacctcatggcttttacattcctcttgaaggctgttgctttcttctagtggcagatccggaacaagcagaccgtcaatatgattttcctgcagtaaagcgaaaaagtattctttgttcaattgtaacacaggattataatacgtaaagaggataatcggaatattcactccgttttttttcatttctccgcctaattcgattgcctttacgatattcattccttgatcaagtgcccgctttgaagccctctggatcaccggaccgtctgcaagcgggtcagagtatgcaacaccaagctccaatgctgtggcgcctgctttttggagtgacttcgccagttcaatcgaaacctcaggaactggatcgcccgccgtaataaacgggataaacaatttttctgttggttgaagatccaatttaaacatgggctttcacctcttcttccaatacattcattaatgtgttgacatccttgtctccccgtcctgataaacagacgagaatgagttgaccgcgatccattcctttggcgagtttgaatgctttcgctaacgcatgggcagattcgattgccggcaaaatcccctctttttctgacaaaagctttaatgcatccaccgcttcttcatcagtgatactgtcataagtgacacggccgctcttatgcaagtatgcatgctccggaccgattccaggatagtcgagaccggctgaaatagagtagggctcaataatttgcccgaactcatcctgaatgagataagtcaatgaaccgtgaataacccctacggttcctttcgaaatagtggcggcatgaagaggcgtatcaattccttttcctgctgcttcagcgccgatcagttcaacatcttcatttaaaaatgcctgaaacatacccatcgcattgcttcctccgcctacacatgccactactttatcaggcagagtgccttcaatacgtttcaactgatccttcgcttcctctccgatcattttttgaaattcacggaccacctgcggataaggatgcgggccgacaactgatccaatcatataaaagtgatcctcacaatgctgaacccagtaccggatcgcctcatttgtggcatccttcaatgttccgtttccgcttgttacaggcactacctccgctccaagaagcttcatgcggaaaacgttcagagactggcgggcaacatcctcttcacccataaacacagtacaggaaaagccgaatttagctgcaactgttgcagcggcaacgccatgctggccggcaccagtttcagcaatgattttcgttttgcccatttttttagcaagcagcgcttgacctagcgcattattgattttatgagaacctgtatggtttaaatcttctcgtttcaaatagattttcgcgccgcctaagtattcagtgactcgatcagcgtatgttaatgcagtcggccggccggaatagtcctttaacagcttataatattcttcacgaaaagcaggatcatccttgatttgtttaaatgctatttctatttcatctaacggctgcatgagtgtttccggaacaaactttccgccaaaatcaccgtatctgcctatttcattcggatatggatacatatcggttcatcctttcttctaaaagcctcatcagattctgatctttttgtccgtttttttcaattccgctggcaaggtcaattcctgccggctgccatttcaataggcctgtgatgctatccggattcacgccgccagcgataaagcagcgtttaccaatagccgcctgctgatattccggcacacattcccaagaaaatgcaacaccagttccgcctctagacccttttacagatgaatcaatcacaaagccgtcaacatgatctttaaagcgggctatttcttgagttgtgttatcttgatggtgaagcgccttccatatttcacagcgtgtcagcttgcgaagaacagcagcatccgtcggtttttcatcaccgtgaagctgaatgacgtcgagcttcaagctcttggcaacacgtgacatcgtctctattgattcattaacaaaaacacctgcaacctgtttttcgacacgaacttggttcagccattttttcacatcttgcggagatacttttcgtttgctttcagcaaaaataaatcctaggtaatcagcctgtgattccgccgcaagctgcaaatcctttagtgaccgaataccgcaatattttaatgccggtttcttcacaacctcactccctaaacaaagcatggattgctttacgctgagaagtttgtctcatcaatgattcaccgataagtacagctcgcgccccatgttcattgacaaatgttaaatgttctaaagaaccgattccgctttcgctgacaagcaaggattctttcggaacgagagatgcgatttgttctgtctgctttacggatgtttcaaacgtttttaggtttcgattatttacgccgagaatgtcgggtgtgaacactttcaatatttgttctagcgttgatgcatcatgaacctccactaacacgtccatccccttttcacctgcttcaagatataattcatgaaggtgtaagggatcaagcacctcgccgattaacaatatggcatccgctccgattcttcttgattcctctacttgaagagaatcaataataaaatcttttctaagtacaggaatcgaaacagcacgctttacgtctgataaatagctgttttccccttgaaaaaacggggtgtctgttaaaacagaaatcgcatctgccttcgcagcttcatagtcttttgcaatctgaacaggcacaaaatcctctttaataagcccttttgacggcgatgctttcttcacttcggcaatcaacccgataaaccgattcgggcttgccagcgcctccttaaatgaacgtttctcgaaaggctgctctaccggcaaaaccagtgttttcacttcttctttcttttgtttgatgattttttcaagcatagatctcttcctctttctgctttagtcgttcaagctgcgcggcagcgcctccgcttgtaatcgtctctaacgccagctccgttccttccttcagtgaggcggtaattcccgccgtgtaaatcgcagctcccgcattaaaagccgtaatagataaagcggaactgctgcttttattttcaaaaatattctgaatgagataggcgctctctttcggtgactgcacctgtaaatcttcaagtctgccatttgtgaaaccgaaatcttcgggtgaaacggtatattcccggcgctctccgtcctttaattcaatcacgtcggtcggtgctgtaattgaaagctcatctaaaccgtcacggcttgatacaaacataacgtgcttcggctgaaacgtctccagtgcgcttgccatcagtccagctttttcaacagaatagaccccaatcacctgacgcttcgcctgtaaaggattgctgagcggcccaagcagattaaataccgttctgaaacctagctcttttctagtacctgctacatgtttcatagacgaatagtaaagcggcgcaaaaagaaatcccatgttgtttgtttcaatgctgcttttgaccttttcgggagtggtttgaatagaaacctctagctcctctaaaacatcagcgcttccgcttttagaagagacagagcgattgccatgcttagcgattttcgcaccagctgccgaggcaacaattgccgaggccgttgagatattaaaagtggaaataccgtctccccctgttccgcatgtatcaacaatatcaggaagtccatcgactgtaagagcgtgtgcccgcattgccttcacaaaacccgcaagctcttctggcgtctccccccgatgagcaagaattgacaatataccacccatttcagaaggagtcatttccgctgccatcatcatattcatcagcgtttcagcctcaccggcagtaagggtttttccgtcaacgcacaattgtagaaatctgttcatcagctttatcctccttgctatgaaacatgtcttctgcaatatgaatcgttttcagcagcgcaccggctttattacagctttcttcgtattcggcttccggaacagaatcagcaacaatgccagcacctgcctgtatcgatgcaacgccgttctttacactcatcgtgcgaatcgtaatacaagagtcgatattcccgtcaaacccaatgtaggcaatacatcctccgtatgtctctctcggtgttggctcgagctcttgcaaaagctgcatggcacggattttgggtgcgcctgttaaagtccccgccgggaaagcagacatcagtgcatcgacaggatgaaccccttttttcaatcggcctgtaaccaccgagataatgtgcatgacatgtgaaaaggaaacaatttttgtgaactccggcacagaaactgaaccatactctgctactctgccgatatcgtttcgggcaagatcaacgagcatgtaatgctccgctttttctttttcatccttcatgagctcaaccttcagtctctcatcttcagctttgtctgcaccgcgttttctcgtaccggcaatcggatggatttctaagtgcccgtcttgaacgtgtattaaccgttccggagagctgccgactatttctctgtctagcagtttcatataatacatatacggcgaaggattgacgatcctaagcactcggtataactcaaaagcatctgcttttatcggcacctcaaatttttgtgataaaacaccctggaagatatcgcctgcttttatatagcttttgattttttctacatcagccataaaagccgatttttcataattagaagataccgtctcaaagctgggtgtcttgtatgaatcagcagagagaaacagctcttttatgtttttttggtccatcattttttcgatgagattttggagctccagatgattttgatggaatacatccattttttcgttttctgtttcctctccagtgagccttgcatattggataaagtggacgtttttggtttcatgatcatacgcaattaatgtccggcaaacaaacagcatgcacttttccatgtctgtttcttttctatgcgaaggaacagaaggctcaatcagcgggatcatatcatagcttaagtacccgacagctccgccgacaaaaggaatgccaagctgaggtgttttgattttgtatgtggtattcatccagttcagcacttcttttagttcatttcctgtgtaaagagagttgctgtcctgatcagcggccgaaaaacggccctgctcttctttaattgtgagaaatggattcaggccgataaacgaatatcttgaccaagtggatgtatcgtccttgctttcaagaagatacgtaatctccctgtcaagcttctctatcatttgaatgggtgtcagtgtatcgactgtgaaggtctccacaatcggtatcgtgtggtgggacaagctgtcctctaaaaatgcggaaatgtttgattggaaattcattgctctcactccttatggcaaggagaatgagaagatggcatgagaggataaaatactatataacaaataaacccaaaagaaagacttcttttgggtagaataaacatacatgtctcagctcaactaaactcattctctgctaccctattctctaactcaactcattctaatcgctttatacacactcttgtgtatttctaagctattcttatcgtattacaattcagtattttttgtcaatgataaatcgggcctcaatacgacggctttttctaaatatacatgtctgatctgatcctgagggacatctgtctggaccgtcatcatgactcttatgcactttttcagaccgcccgttacgtccatttcctgcatacatgttaccggtacatactgccatcctgaaagctcgcgaacagcttttgccgggaaaacagcgtgcaaatcaggtgtagccgaaagaagcatttgaacaacatcttccggttttgtatgattttcttctatgattttctctaacagctgttttgttttttgtaaaatttcttcttcagtatcccgttcaactgtagttgctccgcgaattccgcgaatcatcatgatgtctcctccaatcgccatttgttcagccagctctcaagttcatttctggaaaatgtatgatcagcaactttccctaattcgttgagcacaataaactgaatcttcccgccacgggttttcttatcattcatcatacggtccaagagaaccgaagtttccgtctcttttctgatttgacttggataacccaggctttttagccagctgaccaaacgttttctgtccatttcacagcctacagtcttttcgcttatatataaagcaaactgcattccgagggctacggcatcaccgtgagtgatctgcccgtatccatattccgcctcaacggcatgaccgagcgtatgcccaaagtttaagtaagctcttatcccctcttctttttcatcctgctgaacgacagacgctttaattgaaatgcctttaaaaatcatgtcattcagctgatcattggtgatatcacgcagtgagtggatattcagcagctcctccagaaacgctctgtcatagataaacgcgtgtttaatcacttctgccattccggacctaagctctttttcaggcagagaacgcaggaaatctgtatcatagagcacggctttcggctgataaaacgcaccgattagattttttccaagcggatggttcacggctacttttcctccgactgcgctgtcatgcgccaagagcgtcgtaggcatttgaatgaaatcaatgccgcgcataaaagtggctgccacaaaaccggcaagatcccctacaacaccgcctccaaaagcaatgatgcatgaggagcgatccatatgaaatcgaatcgcttcactctgcagctttgtgtacatgtccatggattttgcctgctctccactcggtaccgtcacttttttcacaggccatttttcttgcagcaaatggagcatttcatcaccatacaggcggtccacttcttcatccgtgacaagcataatccttgttaaaggcctgtttaaagaggttaatagttcgcaagccttttttctgataccttgtccgataaaaacaggatatgacgaggaagcagtttgaacatgcagtgtcttcattaaaattccctcgacagttttctcatattctccacattttctctaatgcggtcaatttgatctaatccgaattgttcaacgactgcgttcgcaatttcccaagcgacagccgcttcagcgactacacttgccgcaggaacagcacagctgtctgaacgttcaatgctggcagaaaacggttctttcgtttcaatatcgacacttttcagcggtttatacaaagtcggaatcggcttcatgactccgcggacaacaatcggcatccctgtcgtcatgccgccttccagtcctccaagtctgttagtagcacgggtgtatcctttttcctcgtcccaaatgatctcatcatggacttcgcttccatttcgccctgctgcctcaaatccgatcccgaattccacacctttaaatgcgttaattgacagaacagcggcagcaagcttgctatccagcttgcggtcataatggacatagctgcccacgcctacgggcattccctcgacaatgacttctactattccgccgatggaatctccgtttgcctttgcttcatcaatggcagccatcatttttttgcctgcctcttcatcgtagcatctgacaggagactcttccgttacgcgctgcaggtcttcaattgacgtatattctgttttttcagctttaacagcgccaatttgcaacacgtggcccgccaccttaatgccaagctcagaaagaatctttttagctacagcccctgccgccactctgacagttgtttcccttgctgaagaacgctcaagcacatttctcatatcacgatgattatatttaattgcaccgtttaagtcagcgtgcccaggtctcggtctggaaatctggcgcttcatttccttttcttcatcttctgtaattggagcggcgcccatgatttttgtccaatgcttccaatcgttattttcaactacgagagcaattggtgaaccgagtgtacgtgcatgacgcaccccgctcataattttggcctggtctttttcgatctgcatgcggcggccgcggccgtgtcctttttggcgtctggcaagctcaaaattgatatcttcctccgttatgtaaagcccggcaggtacaccctcaataatggttgtcagttgggggccgtgtgattctccggctgttaaatatctcatgacttcttctcccttcatcgcattaacgcttttaagtaagactactataacatatttttcagcaaaaagtcagtctatcttttttgataaaagaatgtatcggctgggactaggccaaatttctcgggattgaagatttgctcagtgctgccgacaaaaagaactccattcttcttcaagctatgtgccatttttaaatacagctcttccttcgcgctttctgtaaaataaataaatacattgcggcacacgattaagtcaaagtcttgttcataacgatccgccagcaaattgtgctttttgaatgtaatattctttttgatttccgttttcacttcataacttctatttgcgttttgcgtaaaataacgatctttcacagatagcggcacttcctgtaaagaccgctcctgataaacgccttttttggctttttccaaagctttttcatcaatatccgtcgccaaaatctgatagcccggaagacctttttgctggtccaaaagcatggcaagcgtgtatggctcctcacccgttgagcaggcggcactccaaatctttaaaggcctagaggttttgattaacggcagaattgcagtctcaagaacttcccatcttttataattacgataaaattctgaaacattgatcgtcattctgtccaatgtttcatttaagagagcttgatccttttccaatgccgccgcaaagtccttaaagctttggaacccctttttctcataaagtgacgttagccttctcttcatttgtgcttctttatatagtgtcaaatcgactccggttaattgtttccattttgttgtaaatacgctgtatgtatccatctctactctcccagtctcgctgtctttttgtcctagtatagcttgttttatcaggaaattgtattgtttcaataaaaaaatcagcttttcagctgattttagatcgttgggaaaggcagaggtctgatgcacactgccaatcaaccctttattcactttaatgtaaacctttacaaaacagatcaaaaaccggcggcgttatatgatgccggctctgttacttattttcacaatgattaatagatccagcctgccataagctgctgatatgatactaattcttcattcttaaagaaaatgttaatctcgcgttccgcactttcgagagaatcagagccgtggatgatgttttttccgacaaacatgccataatccccacgaatcgtaccaggtaaagcttctttagggtttgttttcccgatcagctgtctcgtcacttcaatgacattttcgccttcccacaccattgcgaatactggtcctgaagtaataaactcaacgagctctccgaagaaaggctttccttgatgttcggcgtagtgtttctcagccatttgttcagtcactctcattaacttggcgccagctaattgtaagcccttacgttcgaatctagataaaatgtccccaatgagctgacgttggacaccgtctggtttcaccatgataaaagtcttttccatcatattctccaccccatcattatgtatgtataggctttcacactgcacaccgaaatcgtaacatctttctgataattaatcaatccggggcggagaaatttcttaatatctacaaaaattaaaattttcttttaccgatatattttgcgatggctgcaagagacgagcgtgcgcgccctcgtggaagcgtgtttaatttctgaaaagctttctgcagatacatttcgcttactgccatagatgcttcaattgcatctgtttttttgatttcttcaatgattggttcaagctgctcctgcgttgtctcactgttaatcaatttaagctggttttttaatgcaggatttttcagggcatacagcactggcaatgtgacgtttccttgaagcaaatctcctccaacgggtttacccagctcttcttcagttgaagtaaaatcaagaatatcatcaataatctgataagacatgccgacgtaatacccaaaccagtacaatgccttatgaatcttctcatcagctccagacgcaatggcaccaagctggcagctgaccgcgatcaagagagctgtttttcttttgatacggcggagatacgttctgagattttgttccatgttatatttgtctttgatctgctcaatttcccctagacaaacttcaacgatcgtctgtgacaaaatcctatgggctttcggttcgttaattctcgtcatcatttcaagagatcccgcaagcatataatcgcctgtgtacatcgcaatacgattgtcccactttgctttgattgtcggttttcctcggcgaagctctgcatcatcaatgacatcatcatgaaccaaagatgccatgtgaatcatttccagagtgacggcgacatatttaatcttattaatatcgtaatcgccaaacatgccagaaagcagcacgaaaacaggacgaatacgtttccctccggcctgcagcaggtgaagacctgcctcgcttaaaagcgggtaatcggaacgtacggtttgttcaagttctctttcgattacatcaatatcgtcatttaaaaaagagtaggccattttaaatttcatatcattcacccaaacatctgtgttttcatttccatccgatatgcgtggcagcgactccgccagtaaacgaatgatatttaacatttttcaggcccgcctcttcaaacaggcctgccagttccttcattccagggaaatctctggctgattcttgaagccaagaatattctttatagctcttcgcaaacagtttcccgaaaaacggcataatatacttaaagtacataaagtaagcctgtctgaatccgatcatttccggctgggacgtttccagacataccacctgcccgcccggcttcactacacgtctcatctctttcagtacagtcaagtaatcagggacattgcggagcccgaagccaatggtgacataatcaaatgtatcatcatcaaaaggaagctccatcgcatttccgtgcagcagttcaatttggctgaatccgccgtcttttactttctgctcgccgacactcagcatattttcactgaaatccaagcccttgatctcgccgcttttgccggccgcttttgcaagagcgatcgtccagtcagccgttccgcagcagacatcaagtgcttttgcgccttcttttacattcatgatgcgcatcgttttatcgcgccattttttatgctgctgaaaactgatgacagagttcatttggtcatagtttttatatattttttcaaatactccgtgtacgcgctgttcttttgagtcctgcataatggtttacccttcttccactttctgatgataggtttgatcttggctgattgtcttcagacggtttattaaaatgttctgaataggtgaatttagaggcagaagtgactcaatgctgtttttcgcttttttaaaacaatcttctaatatctcttcttttgtttttcccagctgtataaaactgccgatcacatccagaaatgcatcatttccgttcataagccgcttaaatacaaaaaaatcactcgacagctttttccagcgcgggaggctgaagtgttccgccacacgatggaataaagctgattcaacgatgccgacactttcgaaaaaatcgttttcgtccttgaaagaacggtcatacagacgaattttatgttcgttgatttctttaatggctgtagcaagcgtccgaatcatgtagatatccttcatttcagatagtaaagagtagtacagcccgctgaaataatcgcccgcgagaacagtcaattggcggtttttgttttcgtctcgttttatgactctagctgtcgtcacttcatcatgggtatcaagggcgctttgtacaagcatcgctgttacaatataattttctctgtcgttgttttttatgtcagcttcttcaaataaagcatgaaaaagaagaagcttatcctcatcaattttcggcgcagaaatatgcttcgctaaataaggatgagacagcttttgttttaatttcgtgttcagattggctaaagttccgtagatgtcttgcaaaaatatcacccttgtccccaaattcacatttatttcttaatctatgtatgagttttatcttttcattcgcttacgcaggtatcattatagcataaaaaaaagaaattggctgtatcctcccgctgtttgcgagcatttgcttttaacagcggggacagccagcttattttttttcgcttttcatttctccgtacgcggtttgaatcagtgcctctcctctgactttaatggcagaagtatgctctgtaaactgagcgatgatcacttctcccttgtcgagtttttcggaatggtgaaactttgtgtctgttcctcttgtcaggccgatcacattcactccgtcctcaacggctttaatgacgacaaaatcacttgaatgcttttggttcatttatagcaccctctatctttattagtcctggcgtttaatatgttccaatacttctgcacgggcagcggcatcatctttaaaaacgcctctgactgctgaagtcacagttttcgcacccggttttcttacaccgcgcatcgtcatgcacatgtgttccgcttcaaccactaccattacgccatgcggatcaagcgtttctacgatgctttctgcaattgtagaagtgatgcgttcctgaagctgcgggcgctttgcaacggcttcaacggcacgtgccagtttgctgagtcctgtgacctttccgcctcgcgggatatatgcaacatgtgcttttccataaaagggaacaaggtgatgctcacacatagaatgaaacgcgatatcttttacaagaacaagctcctcatggttttcaccgaagatagtctggaaatgttcttttggatcttcattcaagccggagaatacttcggcatacatctttgcgactcttttcggagtatcaagaagcccttctctattcgggtcttctccgatcgcttctaaaatttgacgaacagcttgttcgatttgctctttattaacttctttcatgttctatgtcctccaccaatgaatacatttaatttcgattctagcacatatgtcccgctaaaagcaaagtgaatgccctgtcaggaagcccatgctcttgaaatatgaaaagccccttagaaaggggcttttctgtgaagaaataaagtgtatgtaagctagatgcatacacgatctatattcacaattattttccggcaactgcgtctttaagcgctttacctggtttgaaagcaggtactttgcttgctggaatttcgatttcttcacctgtttgagggttgcgtcctttacgtgcagaacgttcacgcacctcgaagttaccaaaaccgatcagttggattttatcaccgtttttaagtgcatctaagatcgtatcaaaaacagagtcaactgcttttgtagcgtcttttttagacaattcgcttgcttcagcaaccgcattgataagttctgttttgttcatgcctttcacctcctcccaaaaggatacattcagttcgtttattatcatttcttcacagttcagtctgattctaaacctgtctcacaaaaaaatgagagcaggcaagagaaagacaattaaacggctttttaagaaaaactgcactctgaggaatgtttgtccaacaaagtgaagaatttctgtatgtagagtaacacatataaaaagccatatcaagcattttaaagcgtcaatcccttgctcgtcaaggatttaaggtgatttaccgaacaaatattcctttttttccttttttcatcctattccttgatccttttccattattaagagcaaagaaaaaagacctcccattctataaagaggtctaccggtattacaggatgatggcgattaagccgccagagccttcgtttatgattctttctaatgtttcttttaatttataccgtgcgttttcaggcattaatgacagctttgcctgaatcccttctctcacaattgagctcagcgaccttccgaagatatcggaattccagatggagagcggatcatcctcaaagtcctgcattaaatagcgtacaagctcttcactttgtttttccgttccgataatcggggcgaattcgctttcgacatcgactttgatcatatggatcgacggagcgacagctttcagcctcacaccgaatcgcgagccctgccttataatttccggctcatcgagactcatatcagctaaagcaggcgctgcaataccgtatcccgtctgtttgaccatttttaaggcatcagacacttgatcatattctgttttcgcatgggcgaagtcttgcatgagctcaagcaaatggtctcttcctctgatttcgacgcccacaacttcttttaagatttgatcatatagatgatccggcgcgtacaaatcaatttctgccactccttggcccagctcaattccggctaatccggcactttcaatgaattcaaactcgctgaattggccgacaaccctgtctacgtcccggagccgtttaatatccttaaccgtttcctttacggactcctgatagctttcacgcagccaatggttttctttcagcaccattacccagcttgggagattgacattcacttctagcaccggaaactcgtagagggcctctctgagcacattcagcacatctgattcccgcatgctctctacactcattgccaataccgggatatcatatttttcgcttaaatcctggcgcatggcttccgtttccgggtgatacggcctgactgagttgatgaccataataaaaggtttgccaacctctttcagctcttcaatgactctttcttcagcctctatatagtcacttctggcgatatctccaatggtgccgtctgtcgtaatgacaactccgatggtcgagtgttcttgaatgacttttcgagtgccgatttcagcagcctcatgaaatgggatcggttcttcgtaccaaggcgtattgatcatccgcggcccgttttcatcttcatatcctttagccccggggactgtgtaacctacacaatctactaatcttatattcacatcgagtccgtctgacacatgaacagacatcgcctgattcggaacaaatttaggctctgtagtcataatggttttgccggctgcgctctgcggcagttcatcctgcgctcgggcccggtctgcttcgttactgatattcgggagcaccacaagctccataaattttttaatgaacgtggattttcctgtacggacagcacctacgactcctaagtatatatcgcctcctgttcgttcagcgatatccttgaaaatatcgaccttttccaagtgatcccctcccggacttcctatccttttcaattttattaagctctttcaatcaaacacaggacactatatgtgtatgacgttgtcctatttgaatatgacatctttagaaaatttctcatcctcaatctattaatataaaaaaacctttctccctatttgtatgcaagggagaaaggttcattcctttttcatatcattttctaaaaaaacaggttcctgtttgtcatttaccgtatattttacagaaaacgcggggacaaagggggtttcctcccaaatcatatcctggatttcagtcccgggtttaaacgtttttttgctttttttgaggcaagaagtcagctcagtccggtaatcagcatatatttctccgtctccgtcaatcataagcggcaaggaattccctgagattgggcttgtcactgtaagagagcttccatccccaagcttcttctcatcgagtgtaaataaatcgcgagatagcacatccttgtaaggcggatattgatgctcctgacgatacatttggatgcgcaatttcacatcgcgaattttttctgccatctttagatcaattaatttaacagtcggatcgttctctacgtcaacaagcacgtattgatagtctcccccgctttcaaatgccgtacttggaggttcagctatgtatcttggcgctaaccggttaaagtctatcggatatttttgatatagcggtgtcgacatatcttttgtttgaatgggaagcagccctccatttgccttttgaaattcatcaacagcagattgaacctgctttagctggtcttgataaggaatggcatgcacactgcttttccgttcatttggatataaacatccggataaaaacacgactgccgcaaaaatgattgcgcacttcagtttacccatacagcacttccttttacagctttattcattgacagggccgctaaaaaccacgacaaacacaataattccagatatgagcatacacatgtatgcgaatgatgaaatcgtaatcttcaaaaaacggttttggcacttaaagcggcttaaatagatggaagctacagccagaaacatcagacccatggaccctagtgcaaaccacattttcatcaatgccagattcaatgacgtgcgcctccccgatatgtatgatgtaagcgttatattatattttaatatacagcgccggaaaagatcaaccggattttccatcctttgatagaacaaaaaaactgaagcaaagagggggaccttcgcttcagtcaacttgactatattcacctgcacgtttaagaaacactctcttggacttcgatgctatagtatgcgacttggcatacagatgcatcctctattgcctaaatcggcaaaatgtttcaggagatcccaagacttgggtgttcttctgtttttcgggctttcgttcaattaagatatgcgtttcatcatacgattgacacttttacttcacttgattttcaaacgtatttaccaaatcctccatctcgtgggttttccctctcgccattaaagattcaacagcggtttccactttttgtccgttgaataggacctgatggagagcttctgtaatcggcattttaacatcatatttcttcgaaagctggtaagccgctttcgtcgtgcggacgccttcgactaccattcccatctcttcaagaacatcttcaagcttgtacccttttccgagcaaattgcccgcacgccagtttctggaatgaacacttgtgcacgtcacaatcagatcgcctactcctgtcaatccagagaacgtcaagggatttccgcccattttcgttccgagtctcgcgatttcggcaagtccgcgtgtaatcaaagcagctttggcattgtcgccgtaccctaaaccatctgtaattcctgcagcaagggcaataatattttttaaagcccctccgatttcaactccgataatgtcaggatttgtgtacacccgaaaattgtgattaataaatagatcctgcacctcttctgctgccctcatgctctttgaagatgcagtaacagttgtggggtgccgcaaccctacttcttccgcatgactcgggccggaaaggacaacgatatcttttctgacatcactcgggagctcaatttccataatttcagaaatgcgcagaagtgaatctggctcaatacccttgctgacatgaacaaagactgcctttttcgttataaaagggacagcctgtctcagcacttcccgaattgcttttgtcgggaccgcaacgataatgacatctgcgtctgaaacagcctctttcatatctgttgttcctttaatggatgtagacagcttaacattcggcaaataatctttgttttcatgcaactcattaatttgatgaattaaatctgcacggtgagcccacacacacacttcatttccattatcagttagaactaaagccagtgctgttccccaactccctgctccaagcattgtgacttttttcatgtttgattcacacctttttattttctagctcttgcaaatattttgattggtgtcccctcaaaaccgaacgcgtctctgattcggttttctaaaaaccgttcgtatgaaaaatgcatcaattccggatcgtttacaaacacaacgaagcttggcggctttaccgacacttgagtcgcatagtaaattttcaaacgagaaccgttatgagtcggtgtcgggttcattgccacagcatccatgatgacatcatttaagacgttcgtctgaactcgaagtgaatgattttcacttgctttaataatcgcaggcatcagcgtatggatccgttttttcgttaaggcagacataaataggattggcgcataatccagaaattgaaaatgatcgcgaatattttcttcaaattctttcattgtgctctcatctttgtcaacagcatcccatttgtttacgacgatgacgacggccttgcccgcttcgtgtgcataaccggcgatacgcttgtcctgttcaataatgccttcttcgccatccagcacaaccgccacgacttctgagcggtcaatcgcttttagcgcccgcagtacactatacttctcagtcgtttcatagactttccctttttttcgcatacctgcagtatcgacaatgacaaactcctgctggttgtaagtaaatgacgtatcaacagcatctcttgtcgttccagccacgttgctgacaataacgcgttcttcgccgagcatcgcattcacaagtgaagactttccgacattcggacgtccgatcagacagaattgaacaacttcctcattgtatttcgtttctggaatgtttttaaaatgctctgcaacggcatccagtaaatcacccagtccgagtccgtgtgttcccgaaattggatacggctcgccaaagcctagcgaataaaaatcataaatattcgctctcatttctgtgttatccagtttattaaccgctaaaacaacaggcttttttgtgcggtacaaaattttcgccacttcttcatcagcagctgtcacaccttcacggccgttcaccataaaaataatcacgtccgcttcatccatggcgatttcagcctgctggcgaatctgcgctaagaacggctcatcaccgatatcaataccgcccgtatcaatcaaattaaaatcataattcagccattcagccgagctgtatatccgatcccttgtcacgccaggggtatcttctactattgaaattctttctcccgcaatccggttaaagattgtggattttcctacatttggtctcccgacaatggctacgacaggtttacccatagtacccttcctttcaatccagccgctttcatttttacataaattttcaaccggttattaaaatcatttcattcacttttatgaaaagaaacccttcagaggaagggcttaactcatttattatatcagtttttactgggatcacaactattcttaaaaatgtttcacgatcaaatacacgtcatctccgattctgtgagctattccatcaaggatcgcctcaagatttttagcgaaaagctccatctccttttggtcattgcaaaaaaagacaggtgctccccctgcaaccctgtttggatttgtcgtgattacagacaaaatcactttcgtaagagattcactcatcctatcaccttatcctgattcttgataaattcagtcggcattctaatcgcattttccagggttggaacattgctaataatttgaacagccgtttcgggatggtgaatttgcggaagaacaaatactgccactctcccatcatttaaatcccgttttgcaattggtgtcaaagatggttctcctgaatcccgataaaccccgagcacattggaaacatcaaataaaatggcctgacgctgccctaaatttgctatcgtcgctgctgaattaaagtttttcggcgtcaaaataaagcccatgccatgctttaaaatcagttcctgtttctctggaagcccgatattcatcatataaatattatcaacaaacagtcccggaccgtcaaagcgcggctttatgtactcgatatctacaatatccttcaacacactgcccgacataaacttcatagccagtaaaaaacaaacgacagccgctatgacagcagcccagatggataaaaacacatacgcagaggttgtcaaaagcgctgtaaagatcacaatataatttctgctttcaaacgcaatggcaatcccctcaatatatgtgcttccccttgagacaagttcatacgaatccatttgcgtcaatgtgttccgctccatgtttcggacatctctaaattgcgtcgctgccaatgttaaaaatgtgatggccgtaaattcctcctgcaaaagcgccggcataataattgcacctaaaccagccgctatcaaccccagtgcgatgtgaatcactttcccatgaacataggtcggatactggcggtaatccgttttcagcatataaagccttgtcgcaattccggcaatgaccccagcaataatcggatagatgtaatcactcatgacattttggtagctcctttgtttgatcttttgcttttctgaccaatctggcttgcgaggtgttcgtatttagatatgccaaacagcaatatcattcccgcagaacacgcattcagccattgaaagccgccgacagccatagccccggccaacttctggatcacaaatgaatacaccagttcgccttggcacatccctaggacaaataagacaagctgcttctcaaaattcctttcaacagaagctgttaaaagcactattaatataacagcagcccactcaggttttatgatgaaccaaaccgggtcatataatgcaaaaagataaacaaacgcatacgcggcaacgagcgtcagatagaccatgatgtaacgaaaacgatacattcccaaatacccggcatagacacatccgcaaacgaaaaacatcaaatatgcaacattcagggaaaaatataaagcgatgtcatgtatgcttagaataatattagttaaaataaagacagagacggcaattcgtcttttcgtcttttcaaaaataaatgttgtcagaacccacagaaaccacattgaccaatagtaataaaattgttccattttactcctccatattcccagtatggagttcaagcacattttttaaacaatcgatctcacattaaggagtatgatcatgggaaaagacagacaagagaaaaaactcaaagcttcaggcagagtcgaatcagaccgcgaccagtccattcactatgacggagcgacaagccttgaacaaaacggaagattcaaaaagcgaaaatcataatacaaaaagcccaaaccacatatggttttgggcttttatcatttatcgcacactatagcttgatgtattgatccctctctctgtgagccaatgatgggtttcacctttgatcacaaggggcgccttttgtaaatcgtcaatcgttctggcgcccagcacggtcataatcatctttaattcctcaaggatcagctgaatctcctcaagcagtccttcctcaccactgtcagtcagcgcttttaaaaaatgccctgccattccggtgcaagaggccccaagcgcaattgcctttgccacgtcaagtgcatcttgcagaccgccagaggcgatcatggtgcttgcaggaaactcagagcggatttccgccaaactggcagctgtcgaaatgccccacgagttaaaaaaggagattttccgctgtcttcggagattttcgattttcgagaaatttgtccctccgtaaccgccaatgtcaacagctgcagcaccagcttcatacagctttcctgctgattctttgctcataccgaatccgacttctttcacaatgactggtacactgacatgactgcaaatttgttcaatacgttccagtgcgccgctaaagcttctgtctccttcaggcatcacaatttcctgaatcacattgaggtggatctgcagtgcgtttgctccaatcatctcaacagcttcctttgcctgagcagccgttgcctcgcttcccaggttggcaaaaatcagcccgtttgggttttcctttcgaacaatttcataggatagacgctctgatggatcttttaatgctgacatttgcgatcccacagcaaggggaattccagcctgagaagccgctcgcgcaagcgatttattaatctcatatgtaagttttccgccgccgccagtcattgcattgataaaaatcggcgaactgcttgaaagttcgccgatttttgtggaaatatctacttgttctaatgcaagatcgggcagactgacgtgaacaaacgtaatatcatcaagacctgtttcccgcttctggccggtggacaaggcatgattgatgtgttgtctttttcgttctgctcgagtcacgtttatcaccaattattttagtttattcagcttatctccgatcagatctccaagctggaagccagtgcttgtttcttccttcgcttgatattgacggtaatcttcctgatcagctttaggcgtttcttcaagttcacgcatgcttaatgaaatgcgctcctcattttcattcacatcaagtaccttcacttttacagtctgtccttcttcaaggacttcatgcggcgtgccgatgtgtttattggaaatttgagaaatatgaacgagaccttcaacacctggaaggatttcaacaaaggcaccgaagcttacaagacgctgtacagttccttcaagcacatcgccaggcttcactttttcgccgatttggctccaaggtccaggcagtgtatctttgatcgataaagaaatacgttcattatcacggtcaaccgataacactttcacttttacttcttgtccctcttcaacaacgtcagacggcttctctacatgagagtgggaaagctgtgaaatgtgtacaagtccgtcgatgcctccaatatcaacaaacgcgccaaaatcagtcaggcgctgtactttgccatcaagtacacttccaacttcaagagactgaagaagttcttgttttttattcgcttgttcactttcaacaacagcacggtgtgaaaggatcacgcggtttttatcacggtcaagctctacaacgagcagtgacagtgtttttcctttatagtcagtgaagtcttcaacgaaatgtgcttcaacaagtgatgccggaataaaaccgcgaacgccgatatcaacgacaaggccgcctttcacgacatctttcacttcagcttcaaacacttcttttgtttcaaattttttctcaaggtcttcccaagcgcggtctgcatcaacagcacgtttagataaaatcaaagcatcgtcttccacttttgttactttcaggtcaagctcgtcgtctactttaacaacatccgatgctttctctacatgaagacttgataattcactgattggaataataccggattgtttgacattgataatttctacatctacatgtttgtcttctacctttgtcacaatccctttaactacatctccaacctctggcacttgaacatcaatttgattcatttcctctgtcatttgaataacctccttggtccaaacctacacagcttaattaaaacggtttgaaagctgaacatataacatgcccgcttttagccgaatatgtattaaagaatcatccaaaaaagttttttgaatgatcaataaaaagttttattagtattaacttctaataaaaggacaggtttgtcaagcaataacattctatcttcgttgaaaaattcaaaaaaagtggcatttgccatcctcagcgggacttttgctccacagcctcgaggattttatcagctacctcttgaatggaaagcgatgtcgtgtcgatttcaagagcgtcttctgctttacgcagcggagatacttcgcgctctgaatcaagcttgtctcttcttgcaatttcctcaattaatgtttcgaagttgacatcaaagccttttttcacattttcttcataacggcgtttcgctctctcttcaacagatgccaaaagaaagatttttacttctgcatttggcagcacatgcgtcccgatgtcacgaccatccatgacgacgccgcctttttccccaagctgctgctggcgtttcaccatttcttctctgacacttctgtgcttggccgcaattgaaacttggttgctgacttcatctgttctgatcgcctcagttacatcggtgccgtttacaagcactttttgtccatcttttgttgtaatcagctcaatgtctgtccgctttagcagctcagccagtttttcttcatctgtcagatcaacgttttcctgtaaagccgcgtacgtaatcgcccgatacatcgctcctgtatcaatatatatgtacgattttttctcagccacaattttggcaacggtgcttttccccgcagctgccgggccgtcgattgcaatcgataatttcttttccataattcctctccttgctcttttctcctctatggattgtatcacgaactatatgaaaaagggtgaaaaattgatgaataattaatgtttgaaggtttcaatcctattgttttcctccattttatccaccccttcatattgaatcacttttgatacgtatggttcaatatgctgatagtgaaaaagaaattggacaccaagtaaaatgatggcctgaatgaacaataatttgatcagcagccgttcaaatgttttcattggagcacctccattacaaatagtatggaagtgtttgccgatgtttattccattcgggcctttcttctcttatttaactggcgccggatgcagtattgaagcaaagcctgctggtcacctgctgcaatttctgaatactctaaagtcattttgcgttttcctgacttggggtcattaaagattcgtctgacaactgcttctgtttctatttgacgtgtgtgctcctcttcaggaagacggatgatcaggcgcaatgattcccccgattgaaaagaaaggccatcagctaaaaccacggcgatgccgcctgcactgatgttataagatagtgtgcggatctcttcttcatttcccggctgaatttgcacatctaatacggcatcagttcttacatattggcggcgctggattcttttcattttttcacgtggaggcacttcaagacagatcatttgaagtttgtccttcactttaccttttatacggcttataaagcgataaggaacttcgtcttttcccacaaactctaccattacttccatatcgttatgtaaaatcacagttcgccctgtaactacatcaacaggatacgcgatcaaaagttcattgttttcgatgctgaccgccttgctttttgcctttttcaattcattttcttctatatattctaaaagtacagtttctccaatctctatcattgacttcactctttcgcattcaatatactcacgtttttattaaagcacgtaatgaaaaaaaggaaaagacatttagtcctttcctcctattttttataggtctttatatataggttctgcattttttagtttttcaaccttttcttccgatccgtctttggcattgatatacattctgaatgtgtcattttcaattgttccaagcatttcgtaacataacacttcttgacctagttcatttgtaatcaaagcgagccttgtttctctcacttgtacatttttatttaatttagactttgcctctgcttcagtaattgcaggcttaggtatggttctttttctgtgagatgtgaggaagtctcttgctgaaaagccgacaacctcaccgtcatccaaggccactttcatacgaattgcctccgggtacatccggactttattttcaacaggaacatatgaaaatacaccgattttatcatattgggcactttcatcaatttgcaaatcatctgtttcaaatccgtttttctttaaaaatgcaagcgctcggttcgatccgtcatttaaactgattttctgatctttcacttccctgttttggatcaagtataccggatgcccgcccttcttcgtaatatccatataaatcactgctttatggtctgggtctttcatgctgatgctatatacatcgcgatttgttttttttccgctctttaccactttaattgaataattgtcatctggggcaaagcgctcagcaatttgttttgcttcctgttcggaaatttgttttcccttcagatggctgaagcctttctcttcttttttcgtactggtgaaactcgggccaagatcagtgccagtggagaatgcaccaacatttttttcgactgttttaaagctgttgataatcgtattatcactttgtttttcgtcagaagccagggccatttctacgtccatccagcgaaggtttttgctcatgacaaggtgctgaacatgacgcaattcattttgtatatcttcggactgctgatatagcttatttagtgatgtatactcgtttttatcaagcggcttttggtccaaatctctgactgacgttttatagctgaaatcgccgatctttgataatagctcttcagttttattaaacggcattaatgtaagcggcagctgactgacgctgttatgagcttctgatgtaatcctccacacatcgatcaatgcaggcgacagtgatttttggctgttcatggcaagtgttgttccgattttatcatgaagctgatccacctgataggtaagctcatgaaacgcccgctgatagttattttcagcatgaagaagaactgcgtctttttcctggtgttctttgtatccccagtagcctgtaccgactattgcaataccaagcacggcgattaaaattcctctgatcatttatcacacctctttttatgctttctcatatctgctactcacagaaaatgtgtttaccgattcttttaatctgcggacgcccccaaatccacggacttgtagccgtatccggattaaagtagtaaagtgcttcctctgatgggtcccagccattgatggcatccagcactgcttctcgtgccgtttcattcggctgcatgtaaatttgtccgtcggctactgctgtgaaggcaagcggctcaaaaataacccccgctactgaatttggaaataacgggctgttcaaacggtttaaaatgactgctgcaatagcaacctgtccctcgtacggctcgccccgggcttcgccataaaccgcttgagcaagcagcctgatatcgttgttggaaaatccaccaggcatgttcgctgctaccgcatcctgttttcttgcttttgctggtgtattgttttgctgtttattcgcattcgctttaggctgctgcgttgttttttccgcaggctgtttctgccgtgcttctgcttgttgtcttgccttttgtgttgctgcttttgatggtttcgtctgatactttagcggaatttttccgtaatgcgtgaatgtattccctttattgagttgttccatgacatattcacgatagtattttgatttacatattaaggtttgctttgttttagctcctacaaggccgtcaacctcttttaacccgaattgatcctgaaaattccgaactgcccagtacgtcccccatccataaaccccgtcaatttttccgttataatatccgttgtattgaagacgcgcctgaagttcgaccacatcgtccccggttgcccctctttgaatgacctgattcgaaaaggcagagatggtttcagtattgaaaaacgtcgttattgtaaaggaaaaaaggatgagacatgccataatcgatcctttggacttcatcttttcaagcctcctactgcaaatttttaagtgtaatcgtattttctgtaacgaggttatttttatacactctttccttgttatccctcagaacataaaaactgcacgcaaaaaagccgcacggttgctgtgcggcttctatacttgcatcatattaacggaacgggcttttttcgctttacgcaaaccaaaccaccataaaaataccataaatggaagcatataataaatccaattgctaagcgctgttaggataaaatcatatgatccatgcaaaagggatgggacaactaaagaaagagtaagccactttacacgcgccttatcagcggaaaaacgggcttttccaaggtaaaatcccattataacgccaatcaaggcatggcatgaaacaggcagcagcgccctgacaaacgcatgctctacgccgtggccaattaaataaagaatattttcgagggttgcaaaaccgagtgatacacttgtaccgtacacaatcccgtcataatgctcatcaaagtgggcgtgcgggtaaacactgatcatcagtataaaccattttaatgattcctccaaaaaccccgaggataaaaaagaaacgaaaaaacttccgcctcctacattctctttttcaagtacatactggataaacatgatgggaaatacaagaacaaccccgagaaaaaacgaccgaagcaccatatgtacaggttcattatcatactgatcttttaaataaaaataacttaataacgcgatgccgggggcaattcctgcagagatgattgcaaacatcaggcaacctctttcctttatattcctacgtctatcctaccatgttgtttaaaattttacatctgtctgcacttaaaaaaacaaaaagagcatacgaatgcatcatatgctcctcatctttaatggttttctcttttggcgatttccgctgcgatatgccccccgtgaaacctgccgttttcaataaatatttcatttgcattgtttcccgcagcaataaccccggcaataaagacaccttcaacgttcgtttccatcgtttcttcgttgaaatatggacgccctgtttctttatcaatttcaacaccaattttttcaagaaattgatgatcgggatgatagcctgtcatggcaaatacaaaatcatttttaatggtaatgagttctttctctccggagcgatacacaacttcatcctcagtgattttttcgacacacgcgccaaattccatacggattgtaccgtttctgacgagggcttcaaattccggcagaatccacggcttaatgcttggagaatactcattgcccctatataaaactgtgacacgcgccccagatttcacgagttcaagggcagcatccacgcttgaatttttcccgccgatgacaacaacatctttatcaaaatacgggtggccttctttaaaataatgaaatactttcggcaaattctcaccgggtacattcatatagtttggatgatcataatagcctgtggcgatgatacaatatggcgtcttgtaggtctcttttgacgtctcaataacaaatgtattattttccgttttcgtcactttatgcaccatttcaaatgcgttaacacggatgtttttccgtttgacgacttctcggtaatacgataaagcctgaattctgacaggcttcctgttttccgtaataaatgccacatctccgatttcgagcttttcacttgagctgaaaaaggtttgatgcgtcggataattgtaaatactgttaacgacattgcctttttcgatgacgagggcatcaatgccaatttcttttaggtgaatggcagcagatagtccgcaaggccctccgcctataataattgctttttcttgaatcatttctgtcaactcctgcgattggcatttcactttatatttctatttccgaataaaaaaatctcctattttatcataggagattttttatttttatgcaaatcatcaacttatatccagcctctaaaacgcgaagcttcagccattttgcgaacgccgaccatatatgcagcgagcctcatgtcaattcttcggttgttagccatttcataaatattgttaaatgatttgaccatcattttttctaatttttcttctacctcttcttcactccagtagaagccttggttattctgaacccattcaaaataagaaactgttacgccaccggcacttgccagcacgtctggtacaagcagaatgtcccggtctgaaagaatctttgttccttcaagcgttgttggtccgttcgctgcttcaacgacaattttagcccgaatattatgggcattttcttctgtaatttgattttcaatcgcagcaggaacgagaatatcacaatccagctccagcagctcttggttggtaatggtatcgttgaaaagctttgttacggtaccaaagctgtcgcgtcggtcgagtaaataatcgatatcaaggccttccggatcataaagtccgccatacgcatctgagatgccgacaacttttgcccccgcatcatgcataaattttgccaaatagcttcccgcgtttccgaagccttggacaacgacacgcgcacctttaatatcgatgcctctcttcttagccgcttctttaatacagatggtaacaccttttgctgtcgcagattctctcccgtgagatccgccaagcacaagcggtttgcctgtaataaatccaggcgaattaaattcatcaattcttgaatactcatccatcatccaagccatgatttgtgagtttgtaaatacatccggtgccggcacgtcttttgtcgggccgacaatttggctgatcgctctgacataccctctgctcagacgctccagctctctaaacgacatatcccttggatcacaaacaattccgcctttaccaccgccatatggaagatcaattatgccgcattttaaactcatccaaattgaaagcgccttcacctctttttctgttacgttcgggtgaaaacgtatcccgcctttcgttggaccgacagagtcattgtgctgcgcacgatatcctgtgaaaatctttactgaaccgtcgtccatacgaacaggtatttttaccgttaataatctcatcggctcttttaacaattcgtatacctcttcgggatatcccaatttttccagagccttatgtattacggtttgggttgattttaatacatcaagtttgtcctcttctgtatgaccggtgtttcgatcggctgccatttgagttaacctcctagaatcttctgtttctcacatgctccctttcagagaatagtatacaccttcatatgatctgtgcatagaataaacgttatgtttttccatgttttttaacgaaaaaaaactgctgaaatcagcagttttccgttgcattcttatgaaaaatgagtttgtatcgtctctacggcattaccgtccataatgagcttaccatactcttgcaggcgataaatcgttaaagttgtcggattgccgtattcagccagaaccgccacaaccccttcagccgtatgtgaccctagatcttcaaggcttaaaaagtactgcccgtcatagtggtagacagttccccctgtgataccgattcgctgtaagctttctgaaagctgaatgatatcttcaaaggaatggaattgatatatgatgtccgcgctttcatcaagcttgacttgcatttcgatgtaatcatcatcatactcatcgtcttctgaatcgacgtcttggttctttgttacaatcacgaccatcccttgtgcttggagagaatacacttccactgcaatcggtccattcgcttcaaagccgagctctgtatttgcttcattcatcatatctttaaataactggtggactttaaatgagtccttccagaggtcttcttttgtcaatccccggtctgtcaaatcatcgagggttaaaaagattttgatcttattataattcagacgctcaagccgcataacgttccctcctgcctctacttgcacacaaatcatataacacattatatgagatgatgagtcataggttcttaattgttatcagtttacactgagttcactagtaagacaagcacaatgcagtttttattgccatatggatttttgctttttagaagttattctggcccgcaaagagtcacaatgtgtgtttcaggctcagcacctaaacgaagaggcacttttgtcgtgccgtagccgttgctgatcagatacgccgcgtttttaacaatacctgttttccccagttcataagggccgaattttccaaacctgatctggcctccatgggtatgtccgctgagtatcacatcaataccgtcattttcattgatttgttcatgaatctccggattatggcaaaccagaatattcagctggctttcatcaagttctttgatggcttcctcataatgatccatctccatcctgatatcatcaacccccgcaatcgcaatcgtatgcccattgaatgaaaacgggactgactcatttctcagagtgatgacgccgtgcgctttaaatatggaatacagcttatgctgcctgacttcataatcattattcccccacacaaacacgatagggaccccgaaatgtacgagccttttgatgttttcctcgattctcgcactgggcaccccgccctcagctaaatcaccgccgattataaccaagtggggggcatggcttcgcgctttttctaaaaggtcttgatcgatgagacgtttgtgaatgtctgaaataaaaaagattgtcagaggaggcttgcccttcatctttgataaaggaaacgtatgtgtcttcaaatgattgccttttgctgttgcatacatttttgccgtcattgccgctgccgcaacagttagtacaccggcaattttcactgatagcttcataaaaactctccattctttttagaacttatcaataagacggacaataaaaaaaagacgtttctatcgtttgagaaaacgccccattttatttactttcaaaatatagattaatgtcatatttgtgcttcatcatgtaaaaaacagactctctcgccttccatttatcaggctgcggccagagatcagtgcttttctgaataatttcacatctcagtttatggaaatcagtctcggatttttcttcctttttcttaaaataatatgaagtgcagtaggcaaaagcggttgccagcatccaaaataaataaaaggtatggctaagtatttcttgaagtataagctgaggctccgggcttttgatcatgatcataacacataataagcctaggcagataagtgaagcccatcgccatctgcggcattgtgctgcataattttcgaatttttgttttcgttttaccagcgcttggagcatctgtttggtcggcgcgtctgtaaactgatccagctgattccataaggattccatacgcttcacaccttgtccattttcattgctacaatatatgaacgtaaaataaaaaaaataccctattcatccattatggggatgtccaaaacttgtccggtgtaaacatcattgccattcagatgattatacgcccgaattttttcttctcctgtccggcttttataatacttcatggaaatgcggtatagcgtttctttcttttggacggtgtgcttgacaacgcgattcggcacattttgaactggctcagccggctgctgttgctgttcttgctgttgcactgttgattgggaagaggaagcagccgcggcggttgcttcctccttatttgccgagtcttctttttccgctacagcagtctgtttcttatcagcagctgtttgctcttttggcttggaatcttctggctctttttttgactccttctgcagtgcggtttctttagtgtctgcggtatcgtttttatcctctgatttcgggacaacctcatatttgctttggctgctgtcaataaaaacatcttcataatcgtcatgattatccgggtggctctttagataaaataaggtgactaaaacgataaccggcacaaatacaaatattactgcgagtactgtgaataatggcgtttttgttttgccttggttttttttctgttctctttgattttttacagattgtcttgtcggaaggctttctccatcatcgacataatcgtccgccaatgcggcgttttgatcttcataaagattctgggcttttcttctctctactctcgacatgttcgtcatgtttatccctcctcacatgttcaaaacgaatctgacaggcaaacacggcatcaatgataaaatgcgccgtcatcggaacaaataagttgccggtccattcatacatcagaccgagcaaaaagctgattgctgtcaccataataaataacagccattttgacaaataccgaaagtgcagagcggcaaatataaggctggccgcccataaaccgatatgagtctgcagcactcctctgaataacatttcttccgcgaaagcaatcagaagcgttaaaaatataatatgagggattgacctcttactgaatatttttttattgattccgccgtcatcatataaatgagacggaaaccatttcattactgccatatcggctaaaataacaataacagctatagaaacaccataccagatgattcgcatatcgcgaatgtcccagagctttaatacgtcccgtacatcctcaaaaaagaacagtcctgctgcagcagcggcaaagatgatgagtagctgcgtcaaatataactgcttcagcatatcacggtcagtcatatgctgaatataatctttttgctgtttcagttcagctcacctacagtctgcaagctgaatatccggtgcaattccgaactccagctgtctaatggcgccattttactccgtgcccctttttgttcatacaaggataaatcaaaaccgcaatgtgaacagcacgggaggtttccgtcatcaggctcgtatgattcatcaaagtaggttaacagtgcctgccttaaacagccgtcacgctgaagcaaaaatgatacacggtgcattttttccagcttcagctccatgcgatatgaaatttctttcttcatcagttcaactgatgttttcccctgcataaagagatgaatcatcatacgggcctgtgtctctccgacgccatactgaagtaatacgtcacgcagccttctctcatcccgctcctccgtcttttctaggacacggattacgtcggcgatttcttcagctgtgacactctccatctggataatctgttcctgcaattcaaaatcccctggcgcccgcagcaaaatgctgacactcggctttccgtcgcggcccgctctgccgatttcctgcataaaagcttctgccgtctgcgggaggtgaaaatgaatcacatatctgatatcgggtttatcgacacccattccaaacgcattcgtacaacatatcacatcaagctggttatgaataaactgctgctgaattaaaatcctgtcccctgactccaaaccgccatggtaaaagtcggctctgctgctcgttttgcttttaatttcacccgctaattcctcagcccatttccgtgtcggacaataaacaattcccggaccttgcaggttttcaaccagctgaatgaccctatctattttttcggcagtatccgccgcattttcaaccctcagtgcgatgtttgggcggttgactgagttgagatggcgtacagcatactgcagctcgagcaggttcatgacatcttgcagcgtttcctttgtagccgtggcggtcaatgccagaacgggcgggtgtccaagtttttttctcagctgtccgagctttgaataatcaggcctgaagtcgtgtccccattcagaaatacaatgcgcttcgtcaataacaaataggctgatcgggacgcttttcaatttttccaacacatatggagactgtaaagcctcaggagacaagtacaaaaatttatatcgatgaatatgttctaaaacaaattgtctttcctgcctgtttagcatgctgttcaaagctgcagcacgcttttccccccgggctttgagctgttgcacctgatcctccattaaagaaagcagcggagaaacgattaataccatgccgtcaagcatataaccaggcagctggtagcaaagcgatttccctcccccagtcgggagcattgcaatggtatccttcccgctgagtatgctttcaataatgtcctgctgcccttttttaaaggaagtaaaaccaaaaaactgatataacgtttgctgtaatttagtcatattgctgcacctgctttgtcaatgccagtctgatttgaaagtagctgaaccgctgttccagcccgtcgcgaatttgtttgattttattcgtccgcatccgtttggcaaactctgcgatttggagctggtcttctgctgatacataatcattaatcataaacgcaggctcatggagagaaatctcgacaatgtggtcttcaatcgtcgctgttttcagctttctgatttcagcaattcgatgtatcggaaacccttgtttgaccatctgccatgttttcctcgtcgactctgtcagggcattatctaagtgcacatcagaaaggagatcctttaacaaagcatcttcacactccggaagagaatgaataaaataatgtaccgaagcccaaaacatgatatagacataccattcgtcttctttcagcgtatcagcaagctgcctgctagtataaccgatccgatggtgcgaggttaaggagtagacaaaaatttgcgctgctttgttttcaatctttttcaaatgcgcctcaagcatggcaaaaaggctttttgccatctctatatgatccgtatgccgggacaggtatttctttacccagtgaagtgtcttatgatcctttgtgacagggatatactgcctgctcccttgctgtttatgggataggacctgcacaagcagcgaaagccttttccaaagcacaccggcagcctgctgataatgagcgccgtgacaatgaacgggccaaggccgctcgctaagggcatgccttaaaactgctgcgccgctggctgtcactttgtatgtatctgtttcagacattggcgagagatatgaatgcttttcaagcttgtcaagcgactcagaaacatcgcttctcgaacattgcgccgccattccaaagtattttgcagtctgaaataagccggcatcttgaatggtttgtgacgatctcttgcctttgaataggtgaaaaacagcgcttcccgaccgttccccgtttattttgcaaaggcaatcgagaaccataatatcgaagtaatttaatgacaacctatccacctacattcttcctgacaaaaatcgttgatttgctctttttattttaacagatttcaaacagaaatcgacgtttaaagtcatcattaagggggatgttatgtagataaccccttatgtgataagcattctcaatcatttttctgttgaaatgtggcagcaacatcattacaataagtaagaggaataggtgttaaattgattaaatataaagattgatccatttgttccaccaagaacaatctgggaggttttattcatggcaaagtacacaatcgtagacaaagatacatgtattgcatgcggcgcttgcggagctgctgcaccagacatttacgattacgatgatgaaggcatcgcgttcgtaacgcttgatgaaaacaaaggtgttgtcgaagttcctgaggtactggaagaagatatgattgacgcatttgaaggatgccctactgattccatcaaagtggcggatgagccatttgaaggcgacccgcttaaatttgaatagaagtaactaaaaaaagctcccgaacgggagcttttttatttaatggatatgtgcacttcgctgctgctcaatccatggcttaagcttgataaaaattagtgagaatacaaccgtaattacaataccttttatcatgttaaacgggaggatacctgcgacgactgctgtttttagcgcgctgtcggataatgccggtgaatgtaaaaaccacgtgtatgccggaagaatcagaacataatttaaaatactcattaaaatggtcatcgctgcagttcccaaaagcaggctgacagccaagccctttgctgagttgagttttttaaataagaaagcagtcggcaatataaagagtgttcctgcaataaaattcgcaacttgccctacaggaactccggccatgcttccctgaatgatatactgaagaacattttttatcgcttctacggcaatacccgccaaaggtccgtaaatcagaatggcaataatagcgggaacgtcgctaaaatcgatttttaaataatccggaagacccggaaacgggaaatttaacagcatcaaaacaaatgcaatgctgctcagcatgctgaccacaactaatttttttactttcacttcattctctccttttcgatcacatcttactcgaaaacggaaaggttcttttccagccaataaaaaaaccgcttcatatataaaagcggggtttcgaaaattaggctaggcaaagaaacgtttgaaaaattcaatttcaaaacgcttatgaacctccatcttctcccatccagactgtactgtcggctccggaatctcaccgaatcctgctgtaaagacagctcgcgggcttagagccattggctcatcaccgccggtagggaatttcaccctgccccgaagattgatcatatgaaatttaattacattataaacgataactggttggctgtatagagaattgcttcaaattatatatattacctgcaagctgtcaaatcattgatttattaggctttacttttatcctttactgcgtcaatacacgttgacactcttttgagaatatgttaaattatcagatatttagtttgtcaatttaggaggaaatctaacgatgtttcgagtattggtctcagacaaaatgagcaacgacggtttacagccacttattgaatcagactttattgaaatcgttcaaaaaaacgtagcagatgcagaagatgaattacatacttttgatgctcttttggtgcgaagtgcgacaaaagtaacagaagaccttttcaacaaaatgacttctttaaaaattgtcggaagagccggtgtcggtgtcgataatatcgatattgatgaggctacgaaacacggggtaatcgtgatcaatgctccgaacggcaacaccatttcgacagctgagcatacatttgcaatgatctcttctttaatgagacacattccgcaggctaatatctcagtgaaatccagagagtggaaccgcacagcttatgtcggttcagagctttatggaaaaacgcttggtattgtaggattaggccgaatcggaagtgaaattgcacagcgtgcgagagcgttcggtatgactgtgcacgtttttgatcctttcttaacggaagaaagagcgaaaaaaatcggcgtaaacagccgtacatttgaagaagtgcttgaaagtgcggatatcattaccgttcacacgcctttaacaaaagaaacaaaaggcttattgaataaagaatcgattgcaaaaacgaaaaaaggcgttcgcttaattaactgtgcgcgaggcggaattatcgatgaagcagcacttctcgaagctttggaaaacgggcatgttgcgggagcggctcttgacgtttttgaagttgaaccgccagttgacaacaaacttgttgatcatccattagtcattgccactcctcacttgggagcatcaacgaaagaagcacagctcaatgtcgccgcccaagtgtcagaagaagttctgcagttcgcaaaaggcctgcctgtcatgtcagctatcaacctgcctgccatgacaaaagatgaatttgctaaaattaagccctaccatcaaattgcaggaaaaattggcagccttgtatcacagtgcatgaaagaaccagtacaggatgttgccattcaatatgaaggcacaattgctaaacttgaaacatcgttcattacaaaagcccttctgtcaggctttttaaaaccgcgcgttgactctactgttaacgaggtcaatgcggggggtgtcgcaaaagaacgcggcatcagcttcagtgaaaaaatttcctcttctgaatctggatacgataactgcatcagcgtaaaagtgacaggagaccgcagcacctttactgtaacggctacgtatattcctcatttcggagaacgaattgtcgagatcaatggatttaatattgatttttatccgacaggtcacttggtgtatatccagcatcaagatacaacaggtgtcatcggccgagtaggacgtattctcggagataatgatattaacattgcaaccatgcaggttggccgtaaggaaaaaggcggagaagccatcatgatgctttcctttgacagacatctggaagataaaattgtgaaagaactaacaaatgtccctgatattgtgtctgtgaagctcattgatctgccataatcaaaaaaactcaagctatatagcttgagtttttttattgttctatccccgtgtgtttttatgcaaaatatctaagacactccttagctcagaaacaggaatttggcctggtgcggacgcctcttctccagctccaaaagtacaagccgatccaaaaacctcaccgctcagcctgctgatgagccctgttgcagccattgacattgtaataatggggcggtctgcatattttgttttcattgtatacgtcgcatcaagcagtgttaggagatctccagtatcattcggcatgacagccattttgggaatatgcgctcctaaatcctgcattttccgaagtcttgaaagaatctcatctttcgaaggcgttttttcaaagtcgtgatttgacatcaccacatagatgttgttttcttccgccatcgatactaacgcttttacatttgcatctcctgaaaataattcgatgtctatcagatcgatgtcttttgtttggattgccgattccagcaaagcaagataggagctttcgtccatctccatgctcccgccctctttgtgggttctgaatgtaaatagaaatagcttgtcttctaaagatttacgaagcttagaaatgagctttgtgaccgcttctctgtcattcgctttttcaaatacgtcgactctccattcaacaatgtccggattcagtaattttactgtctctgcttcattcagaatttgtttttccgtctttcccatcagcggaacgatgattttcggcattccttccccgatggaaactcctttaattgttaacacgttcactcatctcaaatcctttcaatcgttaccttgttttattatacacgtacaacttttttttgaaaatttctattatatgaatagcaactaaaaaagagcctcaaagggcccattttagtttaagaaaatcggatttggagcagctggcaccggaattgcatctgatacgtcatatttgccgatttttttcgttctggtttccgcaaaggtcacttctgtgaagccaaactcttttgcggttaaaagaagtccctcaatcattaaaataccggcaatagaatcctcaacttctgagtcctttgaaaagcggatatataagtgtttctgtttcttcgttacagattggacagcacccgcttgaataagaggtgtcgtatcttcttggctgctcgattccatttccttaatcgcttcttttactgtatcaaaagaatgatttgacggaacgagaaagtcttgtccttgtttattttggtacaagtagtaggatcgttttgactgtttgggaatcgaaatttccgtaaaagtgccatatgagccaatccgaaccccagtctcattttgatccgataaaaatttgactttttcataaggactccattttaaggattctttaagcaatttttttaacagtgtatcatcttttacagaaaatgccgtagctggctgatggactcgtatacttaattccttctgctttggtttttcctttatttctacttcatctatgaaggttggaattgtaatggcatgatcaaggatgcccaattcactactttcaaacagcatatcctggatcgtttggtctgcatttgttttttggatgctgacgggtatgattgcggatgtatcggcatcagcaactgctacagtgatgtaattgtcttgttccttttcaggtacaacaaacgatgtatgatccaaggacgatgcagcttttgggctgtcttctgtctcagttttcgttactgcgttctcttgggacgcttctttttgttgaggctgtgcctgatcaaagaaatgaggagaaataatgaaggcgatataaaccgcaattgcagcggcacacgcggggccaatccacctgacagcgggcttatttttacgctttgccatcgtcagccgcttgtaaatatcctgaggcgaacgatggtctttaactgccggaagttgacttaacaactcctttatctgttcttcgttccattctgacttcatcatccattagctcctccctcaaaagctccatatgtttccgaagtactttgagccctctgtgttgggtcgtttttactttgctttccgagaagcgcagagccttggctgtttcctgtattgaatatccctgaataaaccgcaagataatcacagctctttgatcgattgtacattgatcaagcgcagcataaatttcccggacattttcatgttgaacggcaagttcgtccggtagcaattgctgatccctgacatcctgtgtatcccagtcaaatgtaccgagtatacgctgtctgattgtttgctgtttacggaaccagtctatcgcaacatggcgtgcgatagacaatagccatgttttttcactgcttcttccttcaaacgtatgataagaatttaatacccggatataaacctcttgaagaaggtcttctgtctggtttttatcctttaccatataaaataaaaattggtacaaatcttgatgatatgtatcatataataattgaaaggtttcttccatttgaaacccctccgttcacttttttgtcgtatgaatagcttgaaaagttacattacaactatattacgagtaactggaatttggaagggaatttatattaacatatccttaaattttattaatgttggctattaaaaaaacacccgctcagtcagcgggtgtttcttatggaacaagattcttcggcaaattcagactcgattttaccgttttgtcggaatataaaaagtaaatgttgttcctttatctattcggctgtgcacagtgattgagccgttgtgggcttccacgatatttttaacgatagccagccctaacccggttcctgctctgccccttgtccgcgctttatctgccttataaaaccgctcaaagataaatggcagatcttcttccggtatgccggacccggagtctttgatatcaattttcaatccatccttcacagaatggactgaaatggagacactgccaccggatgaagtatgccgcagcgcgttatcaatcaaattggtaaatacctgctccatcttgtcttcatcaagcataaattcctcttctgtgagagaaatgtcattttgtaaagcaatatttttttctttcgcaacaccggaaaacttccgaatgatcttttctaaaaactcattcacattgattttttcataatgtaagcctgtatggcctgattccattcgggctaaatcaagcaaatcattaactaaacggcccattcggagtgattcgtcataaatgatttgggcaatttctttccggtcttcttcagagcttgcaatgtcatcgacaattgcttcactgtatccctgaagcatggaaatcggtgttctcagctcatgactgacatttgcgataaagtcctcccgcagcttatcaaggcggcgttcttctgtcatgtcacgcagtacggcaaccgctcctctgacgtgcgattccgcataaagcggcgacatcaaaagcacccatgatctgccttgaagcgtcatctcaatcatttgttctttttcagtgctgacagcgttttgaaacagctcttttgcttcaggcggaaggttgtcgccttctttgatattcatgttctgttcataataccaagcctgaagaaaacgttcagccggcgggttggtcacaagaatcgtaccgtcaatattaatggtaataaccccgtcagccatactgctcaaaatgttagaaagctgctctttttcttgattgagcgcattgatatgaaagttaagctgccggcccatttgattaaaagcggtcgccagttcaccgatttcatcctgagttaaaatcgggatttttgtatcgaacttgcccttcgccaaatcctgcgcgccttctctcatttttcggagagggtacgtgaccctgcttgataaaaagaatgcgaaaaatgtggtcagcacaatcgcaattccagcggcaagaaaaatatagcgggtcgtatgttttgttgtatctttaacggcaagcaaagactgggataaaaagaccatgcctttctttccgtctttttcatacgggacacctacaatcaggcgttcattatccgtgtctgtatcgctcagtcccgtccgtttgcttacttttttatggtcttggagagctttatttaagtctttgtcatgctgtatttgctcaaccgttatagacgacaggcgatttttatcattcggagaataccagtggttcttctcatcctggatgatggcaatgcttgttaagttatcagcgagctcccaagtgattgaccttgccagtgcctggtcctcgtgattttctaggatgacagcaactttattcgcaagctgtgttaaatcattctcggcttcttccacatggtagttttcaataaactccagcaaaagaaccgttaaaatgaacaatacgatcaagacgagtgaaaggatcgtaaaccacagcttgcctactacgcttttccaaaatttcattcagcgccgacctcaaatttataacctacaccccatactgtgacaatttttttcgcagcttccggagataccttgttcagcttctctctcaaacgtttgacgtgagtgtccactgtccgtaaatcaccaaaaaactcatattgccacacttctttcagaagcttttcccgatcatacaccttgtcaggcgttttcgctaagaaatatagaagctcatactcttttggcgtcaggctcacttctgttccatcagctgttacgcggtgagcatcatggtctattgacagatgtgaaaacacgagcacatttttcgtcggtgtattggcattgaaataagaggtttgggatgctcttctcaaaagggcctttacacgcagcacgacttctctcgggctgaacggcttaacaatataatcatctgttcccgcttcaaacccctgcacccggtttgcttcttctccttttgcggtcagcataataatgggtgtcgcttttttttcacgaatttgccggcacacttcaattccatcagtccccggcatcatcagatcaagcaaaattaagtcataattggcttcaagccctttggcaatggcttcatcaccattttcagcttcatctatagcataattttcacgttcaagatacattcttaaaaggcggcgaattctggcttcgtcatcaactactaatatttttgtttcgttcgtttggtccatgttttccccctgctttccttctgttactttcattttatcaaatcgcgagaaagtttgagaactgtgtcgctttcaaaggactatgcataagaatgaagtccggcaagcacaagatttacgaatattaaattaaacataataatagcaaaaccgattacggccagccatgctgacttctcaccgtgccagcctcttgacagtcttaaatgcaagtaagcggcatagaacaaaaatgtgatcagcgcccatacttccttagggtcccagccccaaaacctggtccacgcaagctgagcccaaatcattgcaaagatcagcgcgccgagtgtaaagatcggaaatccgattgatacggccctgtacccaacctcatccaccagatcaagattgacgtttttcaccagcggatgtaatagagcgctgattctttttctgatgatcagacggagagccccatacaacacaagacctgctccaaatgaccaaatgacagtgttcacttttctgcctgagaaaagcgcgggaagatcaacaagcggtttcattcttccttcggtcaaaagctctccctgatgcggaccgacaagcgcgggcatttcgtacaccatcacgcctttttctttacttttgtccacccagttaaactccgcttcatagcctgcaagacgaaatgctgatgtgattgcaataaaggcgacggttgtgaccaggataaacataatcgcttcaagccagaaggtctttttgcttggctttgtctggtctacatgcttcaaaagaaagatgacaccagcgacaaagctgatggcaagtatagcttgcccaagcgcggccgttgttacatgaatatacagccagttgctttggagcgaaggaattaaaggcgagatatctgtcggaaacatgctggcgtaggcaatcagcaataaagcaattgacagcgtaaacaggcctaatgaaggcaatctatagagaaaataaagaatgataaacgccaaaacaagcatcatgccaaaagcggtggtgaattcaaacatattgctgaccggcgcatggccgctggcagcccaccttgtgatgaaatatccaaggtggcagaaaaaaccgacaatagaaagagtgattccaatgttggcccatcggtttggcctgccctttttatctttattcccgcgtatggccccgccgaagatcgggacagcgattaaatacacaagaaaggccgcataaagaaaatttccgctcagctctgccatgacatcactcccttttcgcctatttctgtgttttgattaattctttttggtccaccggttcagtcagtccggaatcagccaatataaatgctaaatccttcttcaggccaaaccagtttttattggtatgccccgctaccataactgcaccgtcctgtgagtgcagccaaattcttcgatgctgccagtacataccttgaataacaccgatcataaaaatggctccgccgacagcaagcacccagagtgtcagatcctttctgactgtaagtccagtaatgtttttcgtttcgacatggtcaaatttcagcttgtatttattattgtctgatccttcgatggtttcttggatggcgacaaagctcttttcgcctttcggtttgtccggcgttataatattaaagacaaaagccggattgttagggatctttgtttttgtgctcggctctccgtcctgattaaaatagaagtcaggcaggtagctggcgatttccaccttgtaaccgttgccaagatcatagaccgaatctggatccagaaggttgatcttcaggctcccaaaggatttttttgtttttttatcaatcagctggaacaccatttggtcaagctgattctctttgtaatccacctggtaaacggaaaaagaatcaaaacgcagcggctgattgacacggatgtcttcttctgttacttttttcagcttcggcttctcgccataaacaatttttccttctctcttgtagagtacggcatcggtttgaaagttctttgccactctaccgtccccgactctgtcaatggcatctgcaaatacctttttttctgttttgctgttataggtctctacgctgaattgattgtttttcaaataatattttccgtctgtacccggaattgcggcggtttcgccttctctgacccaaagcgtctcatcgacgtacatgccaggcacaaatctcagcatcgcaccaatcaaaaagatgatcaatccaatatggttgacatacgggccccagcgggaaaagcgtcctttttcagcaagaatgctgccctctttttctctgattctataatgttttttctttaatagagcaactatcttttctttcgattccccgttcagtacagtaactgtttcactgaacaagcgctgccttcttaaaaaagctgggctccttctgacgccttggttttttaacgctctgtacaacggaatgacccgatcaaggctgcaaatcacgagtgaaatgccgatcgaggcaatgagcagcaaataccaccaagaaccatataaatgatgaaacccgagcaaataataaagctggccgaacgtgccgtactgctccttgtaataagtatcagcctgtgcgcccggaggcagataggcttcctggggaaaaatggtgccgaacgctgatgcggcaagggttatgacgataagccatattcccaccttaaccgaggaaaagaaattccaaattttatcgatgatcgttttgttataggtttgcgaacgtcttgcgcttccgtcatatctcatatcagcgagcggaggttgagtttcctgaagagctcttccgcacgattcgcataaaacggttccgaccgggtttatatgtccgcattcacatttgacttgcttcatcccgaagtctctccgggttttatgagattcatatattcgtgtatcatgctttctgtcatagtgccggtcaccaccttgacaacttttccttccggattgatcaaaaaggttgtcggaagcggagatacgtcataggcatcaagcacttggcgatctgtatccagaacaaccgggaaattgactccgtaggatttcataaaattatgtactgctatctttgactccccaacatttacagcgacaatttcaacaccttggcttttaaaatgcttatattggtttgccatataaggaaactcttttttgcacggttcacaccatgtaccccagaaattcaaaaaaacacctttcccttttaagtcactgagctcgatacgtttcccattcgtatcctcaaggacaaaattcggtgcgtcggacccttcggatatactctctttgccggcaaatacagcattgtaaatggtatagccgagtgcgcagattaaaacgagaaggatgccggtccgaatgaataaacgcctttttttcttcattgtccactgcccccttccccctattgcagatccattcaattatatcattgcacgttcatttcacatttcttactttttgaaggttatgtgaaatttagaaagcgtttttaccgtgatccgccagtgctctgagcctttttacttcgtgaggcgtaagctctctggcatcgcccgtgtgcaggcctcgcaggtttaaaaacgcgtattcctcacgcttcagcttgattacctcatgtccgatcgcttcaaacatgcggcgcacctgtctgttgcgtccctcatggatcgtcagctgaataatgcttgtctgctttttcttatccaaggacagcagcttcgctttagcaggcgctgttttgccttcttccagcctaattccgcgctccagctttctgagcagctctttaggcggaattcctttcaccttcgccacgtatgttttgtctatttcatacttagggtgcatcagcttattggcgaattcgccgtcattggttaaaagcaaaagaccgctcgtatcatagtccagacgcccaatcggataaatgcgctgcggaatatttttaaaaaagtccgtcaccactttgcgtcctttatcatcttgcgctgcggaaataacgcctcttggtttatataagagaaagtaaaccggctcttcgcgttcaacctttaacccgtttacctcaatctgatcagaaccggtgaccttaacacctagctctgttactactttgccattcacctttacttttccttctttaatcagctcttctgcctttctgcgagacgcaactccggcatgagcaatcactttttgcagtctttccatgtctttcacctcaagtattatcttacttttttcaaccttaacaaacaagctttttcaaattcctatgccaaatctaaaaaaaacgccgttttcaggcgctcccaaataataacgtaacgatgatgatagatgcaactacgccgattaaatctgcaagaagtcccacctttaatgcatcacgcatttttttaatgccgactgctccgaaatacacagtcagtacgtaaagcgttgtatctgtagatccctgcatgacggaagccagcctgccgataaaggaatcgggcccgtatactgcaattaaatcggtcgtcattccgagagcggccgtaccggagatcgggcggatcagagcaagcggcactacttcagcagggatgccgatagcggagaaagccggttttaaaagatccattataaaatcaagcgcgcctgatgatctgaaaacagttatagcgacaagcattccgactaaataggggataatggaaaaggcaatttctatcccctctttcccgccttcgacaaacgattcatatgttggaacctttttgatcgttccataaagaagaattccggcaataatgattggaatcatggctaaagacagccagttgatgatttccatccgctcaccttcccttctttttgcggcggtaataaaaataccgatcaatgataatggcaccgattccggaaataagcgttgccaaaatgcttggcccgacgatatctgtcggcgttttggaggaataagccattcggacagcgatcaccgttgtcgggatgagtgtgatgcaggacgtattaacagctaaaaaagtaatcattgaccggcttgcttccgatcggtttccattcagctttttcatttgttccattgctttaatgccaagcggagttgctgcatttccgaggccgaagaaattcgccataagattagataaaatatagcccatcgccgggtgatctggcggtatatcagggaacagtttagatataaaaggcctgcacatccggctgaaaatatccaaaagacctgactgctcggcgattttcattaagccaagccagaaaacaagcacgctcatcaatccaaatgaaatcgtaatcgcttctttcgcacccttaaacacagcttcatttacatcttgcagagttccgttgcacatcgcaaaaacgagtccgatcacggttaaactgacccaaattatattgaccattttgctccgcctgccgcattcagaaagattgatttaaacgtttcaaaaaattgtttcttcggtttttgatgccgctcattttcataatagatcggcacttttgcgatggttgcatcgttgaacatgatctccatgtgccctacgatgtcagggattttcgaggcatctttttcccatgcttttttcggcttgagcagtgtggtattaattttcacatcttctttttcctcttcagtcagcaaataggtgatatcacgtttgataaaagccttcgattcataaaatgtgcctttcagctttggaatatcccctttttttgcaattaaataggtttgataatgctcaaacacatagttaaacatcttcatatggtcatcccaatcattagggtcattaatggtgacggctatcaggtcaatgccgtcctttgaagccgtagagaccagtgtccgttttgcaagttttgtatagcctgtttttcctcctgtgctgtacggatatagcatggtcagcagtttatttttgtttttccatacgctttccatcgtttccgctttgtatatttttgtgcctgaaatcttttgatagtctttcagcttcatagcatacttagttaaaatggccatgtcataggctgttgaataatgattttcatggtcgtccaatccgtgcgggttttgaaaacgggtgtttttcataccaagctgctcggctttttgattcatcatataaacaaacccatcgaggctcccaccgacatgctcagcaatcgcgacagcggcgtcgtttcctgatctgagcatcaggccatacacaagatcttttagcttcactttttgaccttctgttaaataaatggcggagccttctgttctgacagcatttgccgaaaccgtcaccgtttgatccattttgccggattcgatggcgaggacggcggtcataatttttgtgatgctcgcgatccgccttttttgatgctcatccttggcatataacactctgcctgacgcaccgtcaataatgatcgcgctttttgcactgacatctatagcagcatgtgctgtattcacatttacggttgcaataagaaaagaaatcatgatcacgaatactgcttttttgaaaatgcgcatgtttgctcacgtccttgtggtggtttgtacaagtttatgcgcatgtccatcagttatgaataacaattatatttctggaagcaaacataaaaaaactctccctgaaaaagggagagtaaacgttatctgattggcgccatgcttgatccggacgcttcgtaatgagccagctcttccctcatcttcagaaaggccgcgctcaacggcaataataattgctcaagcgacgcaggaacagcatgataaaactcaattgcgctgaccccggtataagacgcccggctattttcacaccacgtgtcttttttcggcataaagaactcttcaatgcattggtgatacacattataaagtgttttttccgctctggcttcctgaaaaggctcctgcatcaggagacggcggcacgcttctgcgcctccttcacaaaatactgccattcttctcagagtgctcagcacatcacagcagtatcctttttcaataggcaattcagcctgtaaggactcaagcgtcgtttgatttaggtaatcgttcacggtattgacaaccattgataagaattcgcctgttttttgagtctgcgctcgcacaatcgaatgtcccatttcgtttggtatcttcccctcatgtctttgtctctcacattttgcttctttcatgatagcttcttccttatatcttatgatgatgaaaaagcgcgattcattaaacttctattttatatcttcgaaggtttggttaaagttttcaaaaaataaatctgcttcttcttgaagaacgtcttcttccgcattttcaggcagcggcggaagctcgtccagcgttttcagaccgaattgttcaagaaaagtcggcgtagtaccgtataaaatggcccgccccggaccatcggcacgccctacttcacacaatagcgccttcgcgacaagactgtgtaaaatccgctctgattttactcctctgatttcttcaatttctgctctcgtaattggctgtttgtatgaaacaatggccagtacttctaaagatgcttgagaaaggccctttgacggcacttcaatcagttttttcaagtaaggcgcaaagtcttttttggtagagagcatgtacgtatctgcatactcaataagttcaatccctcgtgtatcttcgcggtattcgtccgccacatccgccatgatcgtgttcagttcaggctcttcgatttcaagcactgttaacagctgcttttttgtaagcccttcatcgcctgccgcataaagaagggcttccacaatagctttccaattcacgatatcaagccccatgaatggattcactccccgtaatgtaaatatctgaaaaattgtgctcctgttcaatgaggaccagctgatttttcatcagctcgagaacagctagaaaggtcactactaaatgttctttttgctcatatggaaacagatccataaagttgattctcgttcctctagatttcaagctgtgcacgatttcgttcattctggcttcgattggtatgtcctgtcttgtaattgttgtttccatcggcctgtttatttttttgcgtttcagcactttttgaaaagctccgatcatatcatagaccgtgacagagagcttttgctcagactgttttacttcttttgcatattcactcaaatcactcggcggtttcgtgaacgatttttgtctttcttcttcccgttcttttaaatccttcgccgcatctttatattttcgatactcaatcagcttttcaatcagttcctcccgcggatcttcttcttcaagtaattcatcttcaaaaagctcctcctcttgcttcgggagcagcattctgcttttaatgctgagcagcgtggcagccataaccaaatactcgctggccatatcgagctcaagcacgcgcatcgtatgtacatataataaatattgttcagtgatcttcgccacaggtatatcatatatgtcaatttcaagacgattgattaaatgaagcagcaggtccaatgggccctcaaacgtatcaattttcacttgatattcttccatcatctcaccattttcaagtatcactctcattgccggaaaaactggctaccctatagtataagccaccaaaaagctctcgtccaatactatttcatttcctgttttgaacaagtttgtacagaatattcaaaacacgagaggtgtttgctcggagcgcagaagcgggagaaaaagccttagcttctggttttccttctaagaagcaatagaggccgggcgttcttttttccttttatcccttctatggtacactaaaagcacattaaaggaggaaacaccttgtatccgaaagcttatatagattatctcgttgagtttcacgcgacacgggattattttgaatgccatgaaatattagaagaatattggaaggaagatccgccaaagaaacgaaaacgctattgggtcggctttattcagcttgcagttgctttatatcatcacagaaggcagaatacagccggggcaaaaagactgatggcgaacagcatccgaattctcaaagcagaacaccgggcagtcgaagacttagggcttgatcatggccgtttgctcgagcttatgcaatcggtttacgaacaaatcgaaacgggctctgcctataaaagcattatgctgccaatcaaagatgagaaactggaggaagcatgcaggatcgaatgcaggaaaaaaaagtatacatgggggcagtccagtgcactcaggaacatatttctgatcgacaaacaccgtttgcgggatcggactgacgtcatccgtgaacgtgaaaaagaaatagaacgcagaaaaaaaagcagaggctgatgacagcctctgcttaattattgtatgaaatgtcttgatcctgctgaccttgacaacgttcgaaaaagctctgcgttaattcatttggaaccagtacttgcgttttgaataaatgctttaaagcatccatcatctgttttccgattccttgatggcgatgagaaggattcacactgatatgccggatctcaacctcagaatcctttttttcgactccgattgctccgacgatatcctcgtcctctttccaaagaaagagctggcggtctgtatccgtttcgtagtccttaattgtctgctgaagctgcttaaggtctttttcattcggcataaacgaaagaagccccatcgcaatcttttcaaacgattttttataacgaattaacataaaaacccctctatatccaaaatgtccagtctgctattaacggatacgaataggtgatccgttttctcacattatatcattttcgccatatttttaaactgttttcagcaaattattcaaatgagcggtttaaatttgccatttcaatggcagaaacagcacaatctacacctttattgcccgcttttgtgccggcacgctcgatagcctgttcgatgttttcagttgttacaattccaaagatgacaggtacaccagtagtgtttgctgcttgcgcgatgccttttgcagcttcattgcagacataatcgtaatgtgtcgttgcgcctctgatgacagtgcccaatgtgataatagcatcatatttttttgtttccgccatttttttcgcagcaaacggtatttcaaatgcgcctggaacccaagccacatcaatgtcatttgtgtctacgccatgtctgagcagcgcatcttctgctccgctcagcagcttgctcgtaataaaatcattaaatcttcctactacgattccgattttaagacctgtaccaactaaatttccttgtatgatattcatatgattcccatccttttttgtgatatttgtgattagaaatgaagtaaatgacctagcttgttcattttggtttgcaaatattttttattgtgttctttcgcctccatttgaagcggcactctttctgaaatactgagtccgtagccttcaaggcctgcgatttttcgcggattattcgtcaaaagcttcatattccggacaccgaggtcgcgtaaaatttgtgctccgatgccatagttgcgaagatccggcaagaatccaagcgcctcattggcttctacggtgtcataaccttgttcctgaagcttataagcttttaatttattgattaaaccgatgcctcgtccttcttggcgcaagtacagaagcactccacggccttctgcggcaatttggttcagcgcggcgtgcagctgcggtccacagtcacagcgatgagagccaaacacgtcacctgtgagacattctgaatgtacccggaccaataccgggtcttctccgaacggcacatctcccatcacaaatgcgacatgctcttttccatctacctcatttgtgtatccataaaccttaaatgtcccaaaatcagtaggcagcgtaatgtcaacttcacgctcgacgagtgttgtcagattgtaacggtattgaatcaaatccttaatggtgatcatttttaattgatgctttttcgcaatttcaatgagctcaggcactctcgccatcgttccgtcttcattcataatttcacaaatgacgccggctcctggagatccgcaggcttcagcaagatcaacagcagcttctgtatggcccgctcttttcaggacacctccttttttcgcaatcagcggaaaaatgtgccccgggcgctgaaaatcagatggcacggatgtgctgtccagcaatgcttgaacggtaaaagatctttcttgagcgctgatacctgttttcgtttcacgatggtctatgcttacggtaaatgcagtatggtgagaatctgtattatgctccaccatagggtgaagatcaagcctgtctgcgatttcctcactgagcggcgtgcagatcagtcctctcccatgtgtcgccataaagttaatgacttccggcgttgcatgctcggcaagagccacaaagtctccttcattttctctgtcttcatcatctacaacgatgatgacttcgcctttttttaaagcgtccagtgcttcttctatcggatgaaacatgcaaatcttcctctctaaaagccgttttcgcttaagaaggcttttgtaatggtttgttgggtcttattttcattggctttatgcaaaaatcgatacatatattttccgatcatatcgcattcgatattcactttagagccgatcgttttttctgaaaagatcgtttcgctgatcgtatgcggtattaaggaaatcgtcactgtgtcttctgtcaggccgaatatggttaagctcacgccatccacagtaattgatccctttaaaaccaatgtttttgttaatgacgggtccatttttaaatcatagtaaactgcgttgcttttctcttcaattcgtgtgatttccgcagttccgtcgacatggcctgagacgaaatggcctccgaaacggccgtttgccgccattgctctttccagatttactttgcttccttttgttaaatcattcagtgacgtagctttgactgtttcaggcataacatccactgtgaattgattttttgtaaaatcagtgacagtcagacaaatgccgttcactgcaatgctgtcgccaagatgaacatcctctaaaatctttgagcatttaatagttaaggccattgcatgccctgcttttttcatggattcgattgtgcctgtttcttcgataattcctgtaaacatggtcaccatcctattcctttgtcggttttgccgtcagtttgatatcacggccgatttgggttatatcagtgaattgtaataaggggacatctttcattgattgaaaaccttcaccggagattaagctgggagcatgcgttcctccgattagtttaggggcaaaatagaagatgatttcttgaaaacaaccttctttgacaaagcttccgtgaacagctgaaccgccttccacatacaccgacatgatgccttcttccgctaggatcttcaaaacatcaggaatttgaatgcgctcggtttcaagtgtaaatatgttcactccgaaagctgaaagccgttttttcttttcctcgtctgcgcgtgccgtcgtaaaaatccatgtcggcgctatttgatcgcaaatcactttagcgttctcaggaatcgagagcacggtatcaagtataacccgaaccggctgttttgttacattcggcagtctgcaggttaagctcggattgtcggctttcactgtgccaactccgactaaaatgctttggtgtgttttcctgtattgctgagcatcctgtcttgcagcctctgacgtgatccatttgctgtcacccttgctggtagctatcttaccgtcaaggctggcagccgcttttagcgtgacgtacggaaggcctgtcctcataaagtgcagaaatttttcattcagcctctccgcctggtctgccaggatgccttcccttacctcaatgccggcttctttcatcatgctgatccctcttccagccacaagcggattaggatctctcatcgccacgaacactcttttgatgccagagttgataatcaattctgcacatggcggtgtttttccgtaatggctgcacggttcgagtgtaacgtaaatatcggcaccctctgcatgtgctccagccatatggatggcatgaacttctgcatgagcttccccatattttaaatgggcgcccattccgacaatttgtccgtactttacgacaacagcaccgacaagcggattggattcggtctgtccttcgccctgcttcgcaagatctaatgccagcttcatataatactcttccatttgtttccctcccctcttttgttatttaccgtcaaaaaagccccgaatttataaaaaattcggggctttaggtattttacgcaataggaaataacactatgcatttttgaaccatttgcatagcggttcatcatccttctcccatccagactttcactgtcggcttcagcttaaactgaatccaccgcgtgcttatgcacacgggtcacgggctctaaaacaaatgtgctttactaccgccggtcgggatttccaccctgccccgaaggatacaatctttattcatttgtccttattggctattatagcgatcctttttaaagtacgcaatgaaataaacttacaatttgagaaaaacaaaacatcatccttcgatccgaaaggtgatgttttgttaatcattcacttttgcaaccttgattaatccgtcgatccgctttgatttgctgaagtatgccttaatcttgtcaccttcttttatatcagataaatcctgatttaatttttttccgttgaagatgattttcgttccgttttctgctactccatgatactctgagccgtcaattttcgtcactttatattcctggatggtgtattcctcttcttccgaggacaaggtttgtccaattgctgtcggaacatccttcagctcaacatcatttatgtacatataaccgcctgcaagtaaaagcaaaagcactaacagaatggtaatcttggtttttattcttcccatttctaaacctccagccaatatgaatctattcattcatatgagttattcctttttttcatgaataaaaaaccgtaaattctcgtaaattattaatataacgatgcataacgggaatatgtttcacatttctgcaaaaatttcttttctatagatatacgaatttatgttctgtttttaggggatgagcgtaaaaaagatataaaaaaagcagccccaatgggaaactgcttgatcctaatttgttttgcgcatttcattaaacgggtagaaaacaaactttgacgtacccgcaatttgttttttcgtgaagaggccaagtccgttacggctgtccatggaattccgacgattgtcacccatcacaaaatacttgttatcaggcactttaaccgggccgaaatcatcggtcaaaggtttaccgtcctgtttcgctatctttttattagctgccaaataaggttcgtccacctttttcccgttgatatagagctggtcatttttcatctcaaccgtatcgccgggaaggccgataatacgtttgacatagtgaacatcatctccatttaacacgacgatgtctcctctatcaaactcgccgatgtatttgactgtcatattgacaaagaccctttcacggttgtgaagtgtaggatacatagagtcaccatcaacgacatacggcgcaaaaataaagttgcggatgagcaaagcaagaacgacagcaatcacaattgcttttgcccattctagtattgattttttcttcgaaacattttctgatttcaactgatttcctccaataaacaacggtcttcaatttatgttatcacgaatcgaaaaaaaatcccattaggaccattgaagtgattttacaaactgttaatcttcatcttctacccacatcatgcctattttttcttgtcgatcataactaagcctgcaaatattgaaagaaatgaatcgcataattcagaagcggtggactcagaagaaagagagttctcatatgctaaatctttagatcgtatataaggcatgaggttaggaacagtttgttcatttactgcattccattgatgtcccagtccatgatacccatggcatttgacaaaaaacaattcacgtcataaaggttactggaatgttggcggcaacctatttcgcaggtgataaccgcaccccattttttgctttcataataggtttgaaatcattcaagctcgaaaacatggatcagcctccaaaaaataaatcgaatatattcccagcagttgaagactctttattataaaactctgaatatccgcagttcttacagtaaaccactagaaatcggttatgctgcacgtcaaacagctttgataatcccgtgccggttgtggctatttctttttgtcctgcttcagtactgccgcattttatacagcctctgttgtccatatcgcgatctccttttcattacatcacgtttatttgatttattttactacaaaataccaatcccaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaggcatctcctaaatatttttgccattaagtttacgctaatcaactctagcactaatacatataaaaaatagaatgatatgaaaggagacttgatagtatgattgattatcccattaatataaacaacgtttccgggaacagtgtaattaacgtaggcggcgcttttatgatcaggcctttaactttgtccaaatctgtgtttggctccggaggtttaaacacaggaattgtctttgaaaataactttgtaagcaaggctaaaatgattaatcatcaatttactgatcagaacgtcaccaaaactttttaatgtattcaatacacgggggtcactaactaaacacctggttttgccaaccgccatcaaccctgggcggttttttattgcatatttttacccaataaaaaagctctctctatatgaggaagccttttgcctgccaattagccttctacgcgaacttctttcatgacgtcgccattagacatgtttttcgcgaattctaatccgcttgttactttaccaaatacagtgtgaacaccgttcaaatgaggctgtggctcatgaacgatgaaaaattggctgccgccagtgtcttttccgacatgtgccatagaaagtgcgcccgcctcatgtgtatgcgggtttccttctgtttcacatttgattgtgtatcctgggccgccagtaccagttccgtgcgggcatccgccttggctgacgaagccagggatcactcgatggaatgtaagcccgtcataaaagccttcgtttgcaagcttttcaaagtttgcaacagttccaggtgcagcttcaggataaagttcaaattcaattttgttcccgtcttctaataaaaagtaacctgttttcaattgtatgcctactttctttattttaattttcaaaggagattatgtatgataggttatagcctgcctctccttgtcgcggctattataccacacctttcgggggaaaacgaatctcccgagctttactaaaaaataaaaatgaaacctgaatctctttatctccgtctaacctaacggaactgtatttttcatgattcaggtcctcacaaagcagcactatccagctgcttgtgaaattgaaggaggtcaaactgctttgaagaaaatttggattggaatgctggcagcggccgttttgctgctgacggttccgaaggtcagtctcgcggatgccgcagttggagatgtcattgtaacactaggtgctgatttgtcagaatccgacaaacaaaaagtgcttgatgaaatgaatgtccctgataatgccacaacggtaaccgtgaccaataaggaagaacatgaatatttaggaaaatatatatcaaacgcgcaaatcggatcgagagcgatttcttcatcgtcaatcaccattgccaaaaaaggctccggattgaatgttgagacccataatatcagcggcatcacggatgaaatgtacctgaatgcactgatgacagccggtgtgaaagatgcgaaggtgtatgttacagcaccgtttgaagtatccgggactgcggctttaactggattgattaaggcgtatgaagtttcttctgacgaagcgatctcggaggatgttaagcaggtcgccaaccaagagcttgtcacgacatcagagcttggagacaaaatcggtaacgaaaatgcggcagccctgattgcaaaaatcaaagaagagtttgctaaaaacggggtgcctgataataaagctgacatcgaaaaacaagtggacgacgcagcttctgatttaaacgtcacacttacagacagccaaaagaatcagcttgtctctctattcaataagatgaaaaacgctgacattgactggggacaggtcagtgaccagctagataaagccaaagataagattacgaaattcatagaatcagatgaaggcaaaaacttcatccagaaagtcattgatttcttcgtatctatctggaatgcgattgtatctatattcaaataagaaaagcgccgaaaaatcggcgctttcttttattgctttacacccgttttaaatggcagatcaagttttacaatatcttcgtatgtttctcgcttcacgactaaatgagcctcaccgttttcgacaaatacaacggcaggtctcggaatacggttataattgttggccatgctgtatccataagcgcctgtacaaaaaacggcaagaagatcgccttcttttacttccggcaggtcaatatcccaaatcagcatatctccgctttcacagcactttccggcaattgataccgttttgtcatgcgcttccccgatcctgttggctgccgcagcttcatatttagcttggtaaagcgcaggacgaatattgtcattcatgcctccgtctacagccacatattggcggacacccggcacttctttttgagagccaaccgtataaagagttgtgcctgcgtctcccacgagagaacggcccggttcgatccaaatttccggaatgtcaaaaccgtaacgggaagcattttctttcacagcttcgataattttttcaacgtattcagtggcatgaagcggttcatcatcttccgtataacgaatgccgaaacctcctccaagattcagcaccttggatacaaatgaatatgaatctctccattcgtctagttttttgaagattttttccgctgctaacacaaaaccggccgtatcaaagatttgcgagccgatatggcaatggacacccagcagctgaatgtgtttcgattgtaatacttgttcaatggcccgttcagtttgtccgttatgaagatcgaaaccaaactttgaatcttcttgccccgtcgtaatgtagtcatgcgtatgcgcttctactccgggcgtgatccgaagaagaacatcgatggagtgacccgtttctttacataggtcttcaagaagcgcaatttcatagaaattatccaccacaatgcagccgatgcggtgctcaagcgccatacgcagttcttccctgctcttattgtttccatgaaagtggatgcgttctgccggaaagcctgccgcaacagccgtataaagctctcctccggatacgacatctaaagaaagtccctcttcctcagcgagctgaatcattgcaactgatgagaatgctttgctcgcatatgccacctgtgctttcagccctgcgaaaataaaagcctgtttaaagcttttagcacgctcacgtattaaagccacatcatatacgtaaagaggtgtaccatatttctccgctaaatagagagcatccacacctccgatttctaaatgaccatgttgattttgtctgcttgtgccgtgtaagaacaatgtcattccctctttctccgcttatggatgaaaggacagttttatggactgtcccttcataattaagacatacattatcatactcttcagtcagtttcaatgcgattatgaattggtaggctgccttaagcgatttttggggtgaacgatactgggtcttacttttgcgccaggtttcgctgtgcggacaagaacctgccacagcgcctttccgttaaagggaatcagcggccataagtacggtgtctgaagagatttaatgcttgccatggcaataattagcactgtaaatccgatgacgagcccttttatatgaaataaggcaacgagtatcatgaggacaagacggctcattttgtttgccaagcttaattcataactgggcgtcgtaaaggttccaatcgccgcaagtgagacgtacagaatcacctcaggagaaaaaaggccgacctcaatcgcaatctgcccgatcagaacagcggcaattaaacccattgctgtcgataaagccgtcggggtgtgaatggcagccattctgagaaactcgattcctaagtcagctaaaaatatctgcaggatgatcgggatatgcgtatctttatttaaaccgataaatttcatgttgtccgggagcagatgaggctgaagcacaaagagaaaccagatcggaagaaataaagtagaagcaagaataccgaaaaatcttacccatcttaaaaaggtcccgactgaaggcgcctgcctatattcttcagcatgctgcacatggtgaaataaagtcgtcggggtaatgatcacactcggcgatgtgtccactataatgataacatggccttctagaacatgatttgcggccacatccggtctttctgtatagcgcacgagcggaaaaggattatagctttgattaacaatgaattcctcgacagttttgtctgccattgttaatccatcgacatcaatggatgcaatttctttttctacgatctcaaccagatccggatcagctatatcttctatataacaaatgcttaaatccgtctttgaccgctcaccaactttagtcatcttgactcgaaggcgctcgtctctgatccgccttctgagaagggccgtattgacgacgatattttcaacaaatccgtctctggctcccctgaccaccttttccgtatcaggttcttccgggtttctgcccggatagcttctgacgtcaattataaatgcgaagcctgcaccttcaacaatgacagcgacgagcccagacagcacttggtcggtggtttcatccaaggtttttactttttcgacctgggcgttaagcagcctgttttcgacgatgtcgaccagctcatcagggtcttctttccgattgttaatggcaacaagctctctcattaaatgaataatataggctgtatcgcataatccatttagatagtaaagctggatctctttatctaaaatcgtgagcttgcgaacacctacatcatagctcgtccccatcccaacacggtttttgaaatactcttcatttttagctggattccgataaacccgaattttctcttccttgtggtccggcatgatacccgctcctttctaaaataaactcgaccgctttcatggtgattggcgacccttttgagatatcgtcttttctgcccattttgccgatatccccgataccgacaataagcgggagatcaagtttatcaaggcaatagactgtatctccactcattctgtggtcatcaaattctctttccccgactttatcgacgccgtattcagttatttctccattgcggtcaatgcttacatcgaccctggtccattcagcctgatgtgtttttgacgcgaccgcaatcacaccgagcacttcaatagacggatgggttgcgacataggttagagcggcttctcccggaccctctccttgaaggccggagtcgtcaaacatgacaaatacaggatcatacggtgctgaggcgatcagcttgacaagctcggcgccgctgcgggtggaaggattcccttttgattgtgaaatgcatcgacctcccactttgcttgcggcgtattcaattgttttagcggcataaacatccccgtctgttaccagtatgaccttgcgttttgtcgtcatgtcggcattatcctttcggtttgaaaataacagctacgataaaggcgaaaagaatagcggctgagataccggccgaggtcagctcaaaaatccccatgccgattccgataaatccgtgtatatgcgcctgatgcatggcgccgtgcagaagactgtgaccaaagctgacgatcggaacggtggcgcctcctccggcaaattcaataaatttatcgtaaatgccgaaaccatctaatattgcaccgattacaacaaatgatgtcatgacatgagctggcgtcaatttaaaaatatccaagagcagctggccgacgatacaaatggccccgccgcagacaaaagccaaaaggtagtccatgttaagatgcacctcctgcacgctcaaatacaaccccgtgggcgatagtcgggatggtttctttttgctggatcatcgtcgggcttaatagtgccccggtcgctacgacaaatacacggtttaattttccttctctcagctgcttaaaaatatgagagtaggtgacaaccgctgaacaagcacagccgctccccccggcaaagacctgctgatccggagtgtaaatcagaagcccgcaatcatcatgctttgtgccgactggatatccatcttcttttaagatgtcttttacgattggagaaccgacgcctgacaggtcacctgtcaggattagatcataatcatccgctgtccggttgagatctttaaagtgctgcttaattgtatcagctgcagccggagccatagccgatcccatatcaaaagggtctgtaattcctaaatcagaaacctttccgacagtcgcacttgtgatttggatatcacccggtgtctgactgatgacaactgcaccgcttccggttacagtggaggtagcagtgtccggtttttggcctccgtattctgtcggatagcgaaactgtctttccgcagttgcattgtgactgctagtggcagcgagtgcccttttggcaaacccgccatcaactaaggctgatgcgacagcaactgtttccattgatgttgaacaggcaccaaacatacaaagaaatgggattttcaagtgtcttgccacatagttagccgtcacgttttggttcagcaagtcgcctgccagcaataggtcaatatcatcttttgtcagattgtttttttgaagtgcaacattaacagcgtcttccatcagctgccgttccgccatttcccagcttttttgattacaatgcatttcgtcataggttttatcaaataaagagccgagcggtccgtctttttcctttggtcctgctgccgttcccgctgagttgacaaatatgggatgttcaaatacccaggtttgctttcctgttaatttcattttcttctcctcctatgacatcagtttctcaaaagcaaaccgaatcattccaacgatgtatgcagctacaactccgaaaacaataacatttcctgccagtttaaacatatttgtcgctactccaagcactaatccttcgcttttatattcaagagccgcgcttgccatactgttggcaaaacctgtgacaggtacggctgaacctgcgcctgcgaattgtccgattctgtcatagatgccaaaccctgtaagcagggcagaaattaatatcagcgttgcagctgttggattccccgcagttttttcattgaaatcaaaaaaatggatataaaaattttgcagaccttgcccgattgcacaaatcagtccgcccactaaaaaggcttttacacagttccagacgtaaggcggcttaggctgatatgttttcacttttgatttgtaattttcttttatgtttgtcatcttgaaacctccttatgaatggtcaataaagtacagccagtgaaataaagatcccgcgattttcccaatcacgatggccattaataaaataatgattttacttctgagcccgattcgtttcgccaaaatcggcaggacatttaaaacttctgtaagagcagccgctagcatcccgacgaacaaacctgccagaagcccgaccggcacagctatccattttgttagataaagatgattcatatgaagcgtctcccatcccccgcaaaccgcgccaagaatgacagccgcttcataagcctgaacaaatctcattgttttggtgagctgcatcagccgcggaatgattcccattacggttaaaaaagcaacgaaacccgcccccaccgttatgcctccgccgagccctacaaaaataatgaacaatacactaacgatcatgcagatcctttatggtttcttgattctcatgcatggccacatattgatcgagatcaagctgatagttaaacatctcaacctccagcgggctgggctcttcatttaggcgctttttaaatatgtggttaaaaaacacgatcatccccagtcccaaaccgatgctgtatgggatttgaagcaaatatggatagtcattcctctctccggttatgatttcatatagtgcgatatgaacatctctcatgcttacatcctcatgaaagttcatgatggcaagacacgatccaataaacagaagcagccagacaccgataaatagaaccgttgataaatttcgctttcgatactgaatttcaacaatggtttctgctccgcctacggtttgaacatcaagtgtcggatcttgtaaatgaatggctctgaggacttgtatgatatccagaattacgatatttttatctttttcgctcacctgataaagcggcatagccgaaagtttctttttcagctgaagctgcccttctatttgcgcggcatctccaacggtaataatatcccctggatgtgccagcacccggtggcgaagccggataaatattcgtcgttccatcattgatcaccatctttcggtggttatatatgtagtatgtggttcgattttgttctcattcatccgctcgaaaagaccataaattaccacgcttttgcacacaaaaaagctagcctgcactgcagactagccatccgtatgatccatttgaaccttgatctgttttaatattttcttttcaagcctggaaacctgaacctgagagatcccgagccgctcagccacctcggactgtgtctggtctttataatatctgagatagacgattagtttttccctttcctccaaatcgctgatcgcttctttcagcgcaattttgtcaaaccatttttcttctgagttgtcagcgatttgatcgagcagggtaatcgggtctccgtcattttcataaacggtttcgtgaatcgaagatggagcccttaccgcctcttgggccagtacaacatcctcagcttcaatctccaaatggtcagcgatctcctgcaccgtcggcactctgcccagtgttttcgaaagctcatcctttgcgcgccggattttgtttccaagctcttttaatgaccgtgatacctttacggttccgtcatcacggataaatcgttggatttctccgataatcatcggcactgcatacgttgaaaaacgcacatcataggttaaatcaaatttgtcaacagattttaacagcccgatgcagccgatctggaagagatcgtcaggctcatatcctctgtttaaaaaccgctgtacgacagaccaaacaagacgcatgtttttttctatgaggaggtctcttgcctgctggtcgccattttggctttgtttgattaattcctttacttcatgatccttcagctgagcgtttttgccgtttttcttaacctccacatccataacaaatctccttaattacaaagcgctttgctttttgataagtgctttgttaagcgaatcgttgttcccatttcaggcgatgaatcgatactgacatcatccatgaaattttccataatggtaaagcccattccagagcgctcaagctcaggcttagtcgtaaatagaggctgacgggcttcttcaagatctgtaatgcctaagccttcatcacgaatggtcatatatacgacatgatcttccagcgtcactgaaatgtaaactttcccttcacagttctcttcatatccatggataattgcatttgtgacagcctctgacacgactgttttgatttcagtcagttcatccattgtcgggtccagctgagctataaatgaagcaactgtcacacgggcgaacgattcattctgactgagggcagaaaactcaatgtgcatttcatttttcatgatgccacccccagtgtcaggagcgcctgctgttcagattgttcaaatcggataattttaaacagacccgacatatcaaacaatcgcttcaccgcaggagagatagcgcaaacaaccatttctccgccaatttgcttaatttgcttgtatcttcctaaaataacgccaagccccgagctgtccataaaggaaaggtcctccaagttcagcacgatatggcgaatatcatccttctccaatgattgagtcactttttgcttcagggtttcagccgtatggtgatcgagttcgcctgttaatcgaatacaaagcacagattctttgacatgcatgtcaattccaaggctcatgctcattcctccttgatatgatcggataatgagtgtttcgatttcgacggaatgaattccttcaccgtgacaaaactagtggtcattcggcataattacttaaattttgtccagtctcccatcgtccgcttcaagaatgtgataaacccggctttcttcatatcttcttttgcagcaacaggactttcagcgagtacttctccatcctttttcagaacaagagtgccaagctcttggcctttttgaatcggagcactaatatcgtccttcatcttgatttcttttttcacatcgttcatatcctcgccttttttcgtcaatattgaaatcggctcagatgtagtgagttcgatcaatttttgtttcccttttttgacctttacttttgctactgtttcatttcgtttatataaaggatgcgtttcatactggctaaaggcgaagtcaagcatttttgtcacttgcgcgtttctttctttaggcgtgctcgctccgaatacaaccgctatggcccgcatgtttccttttttagccgaagcagtcagacaatatttcgcttcgcctgtatagcctgtttttacgccgtctacaccaggataaaatttgataaggcgatttgtatttacaagccaaaactttttatctgtattttcacgcagataatcttcatacgtgccggtaaacttcgtaattgattcgtatttcaataattccttagccatgattgccatgtcataagcagagctgtagtgtccttcctcggtcagtcctgttgggtttttaaaggatgtatttttcaatcccagctcttttgcttttttattcattttcttcacaaattcttcttcagagccggaaataaattcagccatggcgacggaagcgtcatttcccgaagcgattgcgatgcctttcagcatttctttgacagtcatttcttcgccgggctcaaggaagatctgtgagccgcccattgacgccgcatgttcgcttgtacggaccttatcactcattttgattttgcctttatctaaagcttccataatcaaaagcatcgtcataattttcgtcatgcttgcaggcgccagtctctcattgctgttcttgttgtaaagcacttttcccgtgtcacgttctatcagcaccgcagacttcgcttcatgagcaagctccgatgtacgttttccgtcttgttttgcaaatgcagacggtgcaaatgtaagcagcattataccaatcaacaaagtggataaaagacgtttcatctcaaaagccctccatttcataatcctttttattttttccaagcgggatggttttatacgccactgatggaaaatttttcgaattttgggcataaaaaaagacagctgtgtgatatcagacacagctgtcttttggtcctgcattgattcatatttattcgtactgagcgacgatcgctttaacaagctttaagaatccagcttttactttttcggtcacttccataacttcatcgtgacttaaaggctgatccagaattccggctgccgcgttagagatgcaggaaatgccaagaacccgcattcccgcatgattcgctacaatgacttccggaacagtagacatgccgactgcatcagagcccatcgttcttaagaaacggacttctgccggtgtttcgtaagaaggtcctgttacagcagtgtacacgcctttttgaattgggatattaaggtctttcgcaatcttttcagccaggctggacagatctttgtcataggctgaagacatatctggaaatctggcgccgaaatctgcttcgtttggcccgattaacgggtttgttcccataaagttgatatgatcggtaataatcattaagtctcccgcacggaattcagtgttgacaccgcctgcggcatttgtcacgatcaacgcttccacaccgagcgctttcatcacgcgtacagggaatgtgactttctccattgagtagccttcataaaaatgaaagcggccctgcattgcaatgacggaaactccttcaagagtgccaagcacaagctgtccggcatgcccttcaacagtagataccgggaattcaggtatatcttcatatttcagcttgaccggattttcgatttcgtccgccaaaatgccaagacctgagcctaaaataaggccgatcttcggagattccggcaggttttgtttaataaaagcggctgcgcgttcaattctgtccttcaagaaacagtccccctattgtaatttagataaaaagcttttcccgtatttcggtttatttgtttggaaattatcagcgatcgttgcgccaatatcggcaaatgtatctgcaagcggcaacatttgcgctttcttatgttttttgctgtaagcgagaatcggcacatactcgcgtgtatggtcagtcccatgatgaatcggatcattgccatggtcggctgtaataattaacagatcgtcttctctcattttttcaaacacttccggaagccgcgcatcaaattcttcaagcgcacgtccgtagccttcagggtcacggcggtgtccgaataacgcgtcaaaatcaacaaggttcgcaaagctcagacccgtaaagtcttctcccagcgtatcgatcaccttgtccattccgtccatattagaaaccgttctgcgtgaagaagtaatgccttctccgtcgtaaatatcagagattttaccgattgaaatcacatctaagccgctgtctttcaattcattcatgacagtgcgatcaaacggcttcagcgcataatcatggcggtttggcgtccgtttgaattgacccggctctccgacgaacggccgtgcaataatgcggccaaccatatatttcggatcaagcgtcagctctctcgccgtttcgcaaatgcgatacagctcctcaagcggcacaacctcttcgtgagcggcaatttgcagaacagagtcagcagacgtgtaaacaattaaagcccctgtctccatgtgctcctgaccaagctcatccaaaatcgctgtgccggaagccggcttgtttccaataattttgcggccatatctcttttccagctcttgaagcaattcatcaggaaagccttccgggaacactttaaatggtttatcaatgtataaacccataatctcccaatgtccggtcatcgtatcttttccgtttgacgcttcttgcatttttccataataggcaagcggatgttctgttttttctacacctttgatatcttcgataagaccaaggccgagctttgccatattcggcatatgtaatccgttcatatgctcggcaatatgaccgagcgtatgagcgccttcgtcattaaagtcagcggcatccggcgcttcgccgattccgactgagtccatcacaattaaaaacacacgattatatttgtatgcaggcatcttgaaagcctcctttttttctatacgtctattgtatcgctaagaggtctgacaactcaagtataaaccgttttcattcccgttgacaatgtatttggaaataatgagaaacttcaatattttctgtcgctctaaacaaaaaagccgcagccacctgcggctatgctcgcggatgaaactgcttgtacacatccttcagccttgttttcgtcacatgcgtataaatttgcgtcgtggatatatccgcatgaccgagcatttcctgcaccgctcttaaatctgccccgttctcaagcagatgcgtcgcaaaggaatgcctgagtgtatgcggagtcagctctttcttaatgccggcttccaacgcgatttttttcaggttcttccaaaatccctggcggctgatctgtttgccgtgatgatttaaaaagagggcgtcagatacattattttttaacagttttcccctggcttttgtcatatattcctcaatggcggaagcggcggcttcaccaattggcacaatccgttcttttcttcctttgccgaagcatcggacaaaccccatagataaatgaacatctgtcgttttcaactcagtcatttcactgactcgtatgcctgtcgcataaagcagctccagcattgctttatcccgatatccgaaagggctcgtcagcttaggcgtgtccaataatcgctcgacttcattgagtgcgagcaccttcggaagcgcccgttccgtcttttgtgtttcgatatgaacggaagggtccttatccgttactttttccctgagcagaaattgatgaaaagagcgaatggatgccaaatgccgcgccgatgtcttgccggatttccccgagtccttcaaatactttaagtattggataatatgtatgcgggtaacgtgattccaatctgtaacatgaagggtttctgttaagtagagagaatagcttttcaagtcacgttcataggatacgatcgtattttgagagagccctctctctaccatgacgtagtggatgaaatcctttatttgatctttcactcttgatctactccccgttttggtaaaaaaagatcaaccggtcgaaccatccgcctttttcatcctgatccatttcaacaactttaacagcggagccttccggtttatcataccgatgatagttttcatactcttgattcacccatatcatagcataatagaacaaaccggtaaaaccggtaaacaggatgaaaactttcaatgcatcgacagctgttttcaggaatcttcccatgtcctaatcgatcctttccctatggttccagttatataaaccatatgccaaatcagaaaggttttatacatagaaacagcaaaaaaccctttccccatgagaaaaggttcgcgctcggccccgtctattcagtttcttttccgttacagcggtggcaaatgccgtgaaacgtcaatctatgatctttaatcttaaatttccaatcacgttcaatgatttcttccacgtcttcaagcaaatcttcttcaatttcatcaacggctccgcactccatgcacaccaagtggtgatgaaagtgagctgcgccctctttccgaaggtcgtaacgggacacaccgtctccaaagttaattttatctacgacttttaattcagttaataattcaagcgtacggtatactgtagcgagaccgatctcaggagatttctcttttacgaggaggtatacatcttctgcgcttaaatggtcttcttcgttttcaagcagcactcttactgtcgcttcacgctgtggcgtaagtttatagctggatgagtgcagttgtttcttaattcgatcaatacggttttccatgtctttccctcctacgccgcattccatgactcattataacaaaatacgcgcagagttccaactataattattataaactgataaataaaacggttttcttttaataataattttaaaaaagtctagatgtaagcttttccattaaaacaggagataagtatgcttcaaagagagatgagatcagcgctaaaaacagaatgaccagcagcacaaaggcataccgcccgaaccattgaatcggcgcgtcatgcaggcttcgtttcacgaacagctgtctgattaactttaaagaaaacgcaattgcacatgtgcccataatgagataagccggaatcagcagcacattttgcggcaaaacggagacaaaagataggaaaaacccgcttactcccatctgattgactaggaacccgacagtaaagccgacgacgatccctttcagaaagatcatgatgaaaataatcggcattccaatgacggaaattcccagtatccacatcaggcctaaatactttgcattatgaaagatactttgcccaaacatatcagctgaacttgcctgttttccatccgaaagctgtccaaaaaattgacttaagtagtagtataaatcttctttctggctgatggtcatactgttgacaataatcgcgccaaagatgacacccatgaaaaacagcactgacacaaatatataaagagagagatgatctttgacatgcctgagaaacatgtccttataagagatttttcgcataccgtttcctcccgcccgttctagtgatttgatttaatagattgtatgaaagaaacggaaaaacatgccctttttcaaaaagaaacgatagagacgaatgctaggcggctttttggggcacaaaaaaatccttatcatcaactgctgtatgatcataaggattcttatgcttccgtttattcaaaatctcttttttgctttttgtcattctttcatgtgtgctgaaagatggtgtgctgcctcttgataataagacgtcacgtccgccgtttctcaatcgatgctcccgcttctttttcgcttggctttttgccatgtgatcactcccttttttttcatagtaatgataacaaaattgaacaataataagaaaaaaacagcacctgctacgacaggtgctgtttagctacatttatttcactgctgtaagagctgcatgctcgacagctgctgctaccgcatgatggacttttgaatcaagcggctgagggacaacatcaccttgtttagtgcaagctgcgatggcctctgctgctgcgacaagcatatcatgattaatctccgtgctttttgcgttaagcgctcctctaaaaatccccggaaaaccgagtacattattaacagaacgcccgtcagctgcatatgcggcgccagcctgcagtgcggcctccggctcaatttccggcttcggattcgataaagccagaatcacttgaccagaacgtacaaatgccggttttattaaacccggaacgcccgttgtagcaatgacaatatcacatgtttccataagctcctcaatactggaaactgcctgtccgccgtattgttcgagacggttcattgctgactctgatttgtctgtgccgtacacagcattcacaccataagccatgaacatccggcagatggccacgcctgctgcgccaaggccgatttgccccactttcgcttctttcaggtcaactcccgcactcctgcatgccgaaatggcagctgccagcgtcactacagctgtaccatgctggtcatcgtgcataacagggatgttcagctcctcttttaggcgatcctcgatttcaaaacaatgcggcgaaccgatatcctcaagaaggatgccgctaaagcccggagaaatatgttttactgttttgatgatttcttcaggatcactcgtatcaagcagtatcggaatgccgctaatgcccgccagctgatcaaataaagcagcctttccttccatgacaggcatgccagccacagagccgatattcccaaggcctaaaattgcggttccatccgttacaattgcaacagaattgctgatcgttgtataaatagaagctttttcaggttctttttcgatcagtcggcacacgtccgcaacacctggtgtgtagacacgtcccagctctgccagtgaacggatcggcattttgcttttcatttggatttttccgccttcatgtgcggacaggacttcatcagatacggtgtgaagcctgatcccttctccgagggcctgtacagccgcgatcacttcctgaagctgttcttcattctccacttgaacggtaatattccgcattgtgtaattgggtccgacttttaccgtctccacttcaccaatatccccgcccagaaggccgatggccgtagccacccttccaagatttccgggaaccgaaggcgtttcgatcatcagtgtccgaatcatgtgtttcgctatcattcagtgatcctcccctattagcctagtttttcggctttaactgtattgtttttcgtataccatataaattttcctgtataaccatagataattgcaagacctattgctacaaaactgagccacataaacggcagataagagaaggtagaaacacctaaaataccagccatgtaaatcccattatcagaccaaggtaccatccccgaagtcaatgttcccccgacctctgagttacgtgataacactcttctgtccagatgcaagcgatcatagctgtcttccataattttcggagtcaaaataagagatacatacatcgcacagccgaagatgttcgctaaaaacgctacgatcagtgtagataaagtgacattgccggcagatgttaatttcttttcaaacatagagacgatgactttcagcacgccgagtttctcaagcaggcctccaaaaccaagaccaaatataatcacgacaagggaactgagcattccgacaattccgccgcggtttaacaagccgttcaaaaattcaacatctgttttaatagaaaatccgttgtacgcagtggcaatcgcatccgcaatattcatgccctggaacacagcagcccagattgcgccaagcaaagctccgataacgataaccggcatcgacggctttttcatcgctaataagacaatgacgacaacagccggaatcagcatccaaatatgaatatcaaacgtattttgcaaagatgatttcaaaaattcaactttatcaagatcaatatttttcccgccgtacataaagccggtaatagtaaataaaatagccgtaatcacatatgcaggtattgataaataaagcattgctctcacgtggtccaatacatcgacttttgatagtgaggaagccaaaactgtactgtcagacagaggagaaagcttgtccccaaaatatgcgcctgaaaggatagctcccgctacaagaggaagcggaatccctaatccttctccaattgcgatcatggcgatgccggcagttccgactgttccccatgatgttcctgttgccacagacatgattgaacaaataatcaatgttgctagtaaaaaaatactagggtgaataaattctaatccgtaataaatcagtgtcggcacaacgcctccggcgatccatgttccaatgagcgccccaactgaaacgagaatcagaacagcttcaagaccgtttgatattccatgcagaatcgcattttgcatatctttataagaataaccgagtctgattccgagaatcattgcaataaaccaggaaatgaagagcgcgagctgtatcggcaagtctaaaaagactgtaaacgacatgacaagtgctaaaaatgatcctagtacaataataatttcgaatagtgttggcagtcttacatccttcataagaagtcccccttcatgtaaaaagctaaaacgctttcaataaatagtgcaacacgtatactatacttcctcatccctatgttgtaaacagcttattcatccgattattcggagatgaataagctgcattttgttcaaattttatttttctaagagttctttccctgcaatccctggttttgtcatttcatatggatttaaaataatatccaattcttcttctgtcagcacatcatgctgcaggcaaaggtcacggactgattggcctgtcataatcgcttcccgggcaattctggcagccgcttcatatccaagatgcggattgacagctgtgatcacgcctgcgcttttttctacgtattgcttcatacgcttttcgttggcttcaatgccttttaagcagttgtcagtgaacgaacggaagccgttgttcatgatgctgatggattgaagcaaattaaagacaagcacgggctccatgacgttcaactcaagctggccggcttctgaagcaaggcagattgtattgtcgtttccgataacctggaacgcaatttggttgatcagctccgccataaccgggttgactttccccggcataatagatgaacccggctgacgtgcaggcagagaaatttccgcaagtccggcgcgcggtcccgacgccattaagcgcaggtcgtttgcgatcttcgacatgttcatcatgcagacttttaatgaagctgatacctctgtataggcatctgtattttgtgtcgcatcaacaagatggtcagcgccgacaagaggaagcccgctaatatcagcaaggtgctttactacctgtttgatatattcaggatcagcgttcagccctgtaccaacagcagttgcgcccatgttgacttcatacaggtgctggcgcgattgcttgattcgtttgatatcacgctcgagaacacggctgtaagcttcgaattcctggccaagacggatcggaaccgcatcttgaaggtgtgtccggcccattttaataacagagtcaaactcctgtgctttttgcttaaacacactatgcatatcttccattgttttcagcagtttttctaagagcttcaatgtggaaatatgaatagcagtcgggaacacatcgttcgtagactgtgacatgttcacatgtgtgtttggacttaaatggatataatctccctttttatgtcccatgatttcaagcgcccggtttccgataacctcattcgcgttcatgttcatagaagttccggcaccgccctgaatcggatcgacgataaactgatcgtgccacttgccttccagaatctcgtcagcggcttgtacgatagcttggccaattccttcatacagccgtttcacgtccatgttggcaagagccgcagcttttttcacaatcgccaatgcgttaatcatttcctcatggattttgtatcctgtgatcgggaaattttcagaagcacggagcgtctgaattccgtaataaacatctgcctcaatttgtttttccccaaggaagtctttttccacgcgatattctttttggccgtttaacataatctttaaccttctttctctttgctggttatcgtttttacattttacaggacaacgtcatcagctatcggcgtttccataattctcttgacgacaggaagatccgaagactgacctagcgcccacatcaattttggcacaattgcttctgtgttcatatttcttgatcggataattaagtcttggttgactctgcggccaacctcgtaaatgctcatgtcttcgccttcttcaagacattgagtcgtaatgacgacgacaatgccgctttcgatcagctcattcacttttgacaaaatgtccctgccttcaaacggcacccctccgctgccataactctcaatgacaattcctttgtacatgcttttcagggcatcaaacatttcaggctttaagcctggatgcagcttcagcagacatacatctgtgcatagtgaagtgtcaactgtgaaggtgtcgttctcaggttccgttacttgtttgttgtattcgatcccgtcttcattgataaaagcgatatatgggtaattgatgctttcaaatgcgtcgtagcttttcgttcttaatttgatcgcacgcgttccctgaatgactctgccgtcaaatacaacataaacgccgcccacgccttcacaggcaaatcgaatggcatcagtaatattttttttggcatcggttttttggaacgtgatcggaatctgcgagccggtgatgacaatcggctttttggcatgctgcagcatatacgatagtgctgcagatgtataggccattgtatctgtaccgtgagtaataacaaacccgtcataggcatcataattttccttaacggcttccgctatttccacccagtattcaggctgcatattggtgctgtctatattcataagcgactgagtttccattgtgtaatcgttatcaagttttgatacgtaacttaataattcatcagccttgactccgggagccagcccattttccccttcaactgaagcaatcgttcccccagttgtcaacatcaataattttttcataccatgcacctcttcactgtatctaaagatgggttgcgagaaggtattcgcttttcgcatacttttaatgcaattatagacacggaaaataaaatacgcaagacattattattcaattcgcgtacacttcctaatacctatatgatataatcagctcaaggtgaaaaaggagcggaagttcatgaatctagatcgtttaactgaattgagaaaaaagaaaaattggtcgcttcaatatacagctgaccttctcggtatcgcaaaaagcacatatgccggctacgagtcaggctaccgacggccttcacttgaagcgcttgccatgctggctgacctctttgacacaacctgcgatgaacttttaggccgcgagaaacaaaagcagactgctcctcaggccatagaattggccacgtggagcagccttgactttaccatttctgttgatggccagccgctgagtgaagatgaaatcatccagctgattacctttatacgcacaaaaagaaaagtacaggaggaactgagttaatctttagctcacggtttaattttaccgtaggttcctcctcctccggctttcaattccagttttccggatctcgcttttacgataagcgccgcggttttcggcgggacaacgcgagccaaatcttcttctgcagcctcatgaagaacagccatttctgttccgaaggctttttttagtttgtccagcgttttcgggcctacacccggaacaaattgcagcgggatctgatgtacatatcgcggacgcgggacgcgaacttcaagctgatcactcaattcacgcaatctttcgctgactcccttggtaaatctggcatttccgcaattcacgcacgctgtttccccgcttacagcaggctctccgcacgcttcgcaagcagtctgataatatttccccaataacgggtccaagccataatttgcgataattttcctgtcatcttgtccctttaatgcaagagcaaattcagtaaaatcagctgactgcacatatagttcattatattctctgccgattttccccaacgaatgcgcatcagaatttgttaaaaaaggatacggattcaattcagatacctgtgatgccatgtctgtatcacagcttaatccaagctccaccgcgtctatcatagatggatcaaaaacctcagttaagcttgatttaaccccttttccatataagcttttatgcggcgtaaagatatgggcggggataaacaagccgcccatatcctgcacttttttttgcaggtttaagcccgtttcataaatccgctgcgagcttaaatgaatatttttcagccgggctgacagccagtttgaaaactgtttcatatcagccagcgtcggcataaatacgagcacatggatcggtccgctacaggcttcatcataaatctccagctcgctccccaataaaagagtcgtgctgcgataacggattcctcccccgtcaagctcgcgatattttccagatgaaatgccttcctcaagccctagaatgacttccggagaatgacagtcgataatgccgaggagttcaattcctttatgttcactggcttcaaccaaaattctgtccagcgttaatgttttggcgcctgttattttgacagcccttcctgtaaaagtccggccgatatgaatgtgcaaatccgcgtaaatctttttcatttttgtgcttggagcgcttctttcagttgaagatactgaatcgcgtaggctgttttagcatcatatacttcacgcgattcaaccagctttagcgcatcttcaagcgtcacctccatcacttcaacaaactcgtcctcatcaagctcccgtttttcttcaagcacagaaagctcctcagcaagaaaaacgtgaacaatttcatctgcaaatccgggtgatgtataaaacgcagttatttttgtcagtttttttgctgtataaccggtttcctcttcaagttcccgaagtgccgtatactccggctcctcacctttttcaagcttaccggccggaatttcaacgatcgtccgctcaagcggcttacggaattgtttgaccatgatgattttcccttcatctgtgacggctagtaccgctacagctccagggtgtttcacaatttcacgtttactggcctttccgtttggcagctctacatcctcgacataaagatcaatgactttacccgaaaagatctgttctttggcaattgttttttcttctaatgatttcatttcttcatctcccgttctgtctctatatgatgccccatacattttatcatactagagcaaaagggggcttcttcgtgaaagtgcaccgcatgccaaaaggtgttgtcttagtcggaaaagcatgggaaattcgggcgaagttaaaagagtatggacgcacatttcaatatgtgaaagattggatctcaaagccataaaagttgaaactttagctcctttatattacggtcaatacaaagcctaaaaaaggagtgtgcacatgaaaaagcgcaaattgggtacatctgatttagacattagtgaagtcggactcggctgtatgtctcttggaactgaaaaaaaccaagctttgtccattttggatgaagcgatcgagcttggcatcaactatttggatacagcggatttgtatgaccggggacgcaacgaagaaattgtcggtgatgcgatccaaaacagacgccaggatattatactggcaacaaaagcgggaaaccgttgggatgacggaagcgagggctggtattgggacccttcaaaagtttacataaaagaggcggtaaaaaagagccttacacgtctgaaaacagattatatcgacctttatcagcttcacggcggcacgatagaggacaacattgatgaaacgatcgaagcgtttgaggaattaaaacaagaaggtgtcatccgctactacggcatttcttccatccgcccgaatgtgattaaagaatatgtaaaaaaatcaaacatcgtcagcattatgatgcaattcagcctgtttgacagacgccctgaggaatggctcccgcttttagaggaacatcaaatcagcgtagtcgccagaggtcctgttgccaaagggctcttaactgaaaaaccgcttgatcaagcttcagacagtatgaaacaaaacgggtacttgtcctattcattcgaggaactgacaaatgcccgcaaggcaatggaggaagtggctcccgatctttccatgacagaaaagtcgctgcagtatctgctagcacagccggctgtcgcttcagtgattacaggcgccagtaagattgagcagttacgggaaaatattcaggcagcaaatgcacggcgtttaaccgaggaggaaatcaaagcgctccaatctcatacgaaacaagacatttacaaagctcatcgctcatagcagaaaaaccagcacccgtacaggtgctggtttatttatattgatgccaatccatttggctttcatttaggagttcttcaaagctcttatttttttcgatctcttttttctttctgatctgttctgctttttctctttcctgcctcttttcatcctcttccttcaattggctcttcatctccataagctttgctttgatatcggattgaaggccgtcttttagctggtgtttgtcagcggatttttgttttttcattcagacttcccccatgttttgttttgaagacagtttatcacggagcatatacactgaacaagcagactctcttctggtcactttctcagcggagcagtgtttaggtataatgatttcaaacacgaattacctatatttagttgaaaggtgctgtgacttttgaagaaaatccttttggccattggcgctctcgtaacagctgtcatcgcaatcggaattgttttttcaaatatgattctattcatcaagaaaaaaacggatgaagacattatcaaaagagagacagacaacggacatgatgtgtttgaatcatttgaacaaatggagaaaaccgcttttgtgataccctccgcttacgggtacgacataaaaggataccatgtcgcaccgcatgacacaccaaataccatcatcatctgccacggggtgacgatgaatgtactgaattctcttaagtatatgcatttatttctagatctcggctggaatgtgctcatttatgaccatcgccggcatggccaaagcggcggaaagacgaccagctacgggttttacgaaaaagatgatctcaataaggttgtcagctggctcaaaaacaaaacaaatcatcgcggattgatcggaattcacggtgagtcgatgggagctgtgaccgccctgctttatgctggtgcacactgcagcgatggcgctgatttttatattgctgattgtccgttcgcatgttttgatgaacagcttgcctaccggctgagagcggaatacaggctcccgtcttggcccctgctccctatcgccgacttctttttgaagctgaggggcggctatcgcgcacgcgaagtatctccgcttgctgtcattgataaaatcgaaaagccggtcctctttattcacagtaaggatgatgactacattcctgtttcttcgaccgagcggctttatgaaaagaaacgcgggccgaaagcgctgtacattgccgagaacggtgaacacgccatgtcatataccaaaaatcgggatacgtaccgaaaaacagtgcaggagtttttagacaacatgaatgattaaacagaataaaaaagcgaaaggcctcttcggctctttcgcttttttatgttacagaacgtcggtaatgccatccatattttctctgatccattcaatcgcaagatctatcgttgtaaactcctgcgtctcgaaggtcatttcatcctgcaatagccagacatctttcttgatggactctgctcctccgattgaccagtgaagcaaggtatagggatggttttgattcaggaaggatacccacgttttattttgtgctgtgttcttcattgccttcagcttttgttccacgtttcgcgtctcctactttactaatatgctcattctggggctgagcatttcagccggacttttcagcgccaatgttttggctttttcattgtaatcgatcgtcatttgatcgtcaaaaaacactttttgcgacgattggatatacagcggaatgccgttcgtttccagctgctcgcactgtcccgttaattcttctgccagccagattgtcgggacaccgcttacagcgcagccgcatccttctgcatcgtaacgaagctgggcttttttccccgggttggcgtcaaacgcctgctgcagtgcctgttttgctgcatctgtcacatgtatgttcataaggtgaaacccccgttttcatcattttcgctattgtagcatacaacactgccattcgcattgtttctgccttttttccaccgcttcgcattttcttctgcagtcttgatccactcatctttcccttgtatgtactgattgatgctgtcgggatgctgggccgccagccgttttttgagaacggcgtattctttcgctatgtttggatgagctctgagataatctctgaataacagatgcctttcaatagcagggtttccctgttcgtacatatggacatgatgagtgcgtttatttccgcccttttggaaataacgcctgcccgctatgccgttctcaccttttggtgtatagccgttagccttcatttgttcatcaaattggctcacggcttcaatgcttctgacttcaattaacatatcaatgattggcttcgctgccatgttcggtattgatgtgcttccgatgtgatgaacagcgataatctccggcccgaacacaagtttcagccgttctttttcttcatcgaaacattctgcccatttttcgttgtagagaatgacctcaacttttcttttcggatacaaatgaaagaccgacagcaatagaccctgcgctgctttgacggtttctgccttttggaatccggcctgtgtatagagtgacacggccggggtattgttctcggctgtgactacttcgattttctcagcgtcttcattatgatcaatgacaaattgcagaagcgctcgtccaattccttttctgaaaccgtcaggatgcacaacaagcctgcaaatggtgagatgatgcatgtttttctcatatgaaatgacaccgatcagcttgccgtttttccgatatcccgcaaaccgttcatgggatgcttgaatatccttcaccttctcttgtaaagcgggaataccgtcaaaaccaataatctctgtttcctttatgtaggcggggatctgtacggctaaaatctcacgcgctatagtgtcttccttatgctggataaattcaatcattcgtgttcctcctgaaacagccgctgtctttcgacttttgcgacgcggactgcatacgactcgtaccaaacgctttttcctttttcttttgctgcttgatgttcagtgtgatgcctccaatggttaattgcgtccatactgtcccaataggaaactgtgatgccccttccatccgcttcacgtacgctttccacgcctaaaaatccaggctgatccgccgcaagcgataccatccgctccgctgtttctccatatcctgtgtcattttcgcttttgacagaagaaaaaatgactgcatagtaaggaggctcaggtgtttttgataaaaaattcatcatatttccccctcatatgtttttgacaaacagtaccctgtcttggcctgggccatcatagtttgcaaacactgagatgccatttaccgtcttggtgcccttttcaatatcaaaccccaattttgtgtgatatgcgattgataccttattcacaggtgaagtgacgcactttacccgggtgcagcctctttgttttactgtttcgataaatacatcatacaattgtttcccaatttgcatttttctgaaatctggatgcacaccggaaaaatgaatgtacgccgtttcaggatccgattgcgattgaaatccgattaaaaatcccgtcatgctgttatgttcggatgtaataaagcttgtgtcctgaaaatgctcaaaaaatagtctcggcaatttttctttcagctgtctgccgccccaccattcattcagtacagacgttaccatttcataatctgaagacgtgattgttcgaatatccattacgatttgatctccctccgtctggcaaaacgaatgtcagctctttttctcacaatataaaaattatattttgcctggctggaattgtaaatgccttctttcctttatcatacgtttccagactgccgagggaacaatgtttcatcattttagcctatttctcccccaagcaggaggagagactttacagcacaatatcaagcacttgatcaagtctcagcttataaagctgatcctcgtctccttttatccatactgctttttcaaactcttcataccggcagatcttcccggtgcagcggacaatctcaccgtcctgaaagcagctgacagtgatatcctgagcgaactccatcgcggcgcaaagcgtttgattcatctcttccagcttatcggggtcaaggatcggcttttgcagcttctgtttaagccgctttctctccagcaggctttgcttatgttccggcagaaacatcctgctcccttcccacagcaggttgcccctttttaaatgatcgttcatttataatgcccccctattttagccgcacgttcaaatgcctggcctgccgctgtcagtgacgccgccctgatgattgctgtgtcgccgaatcgatttttaatgccgtccatcacatagcctaggctcattttctttgcataatcctgaaataaattgagctgccatatgtcatcagatgagagctgagacagattgacaccgaggcggcggacgggtttcccgtcccaaaatgtaagaaacagccggcgtacagcctcatatacatcctgagtagaattagtcggctctgccagcttcacttgccggttgaagcccgtcggccaatcaaaatcagcaccccggcagctcactgacaccgtctgccccatgaccccggcgtttcggcttcgcctgcacacttcttcactcagctcaagcaatacgaccttgatttctttgtcaaagtgttcgtagtctctcgggagagtcattccatggcctatcgccttttgcccgtccagagacgaagttgacacaggggaatagtcgattccgtttgccgtcatccacagcacgtggccgttaatgccccatttcttttttaaaagatcgagcggaaaagccgcgagcccgccgatcgtgctgatgcccatccgatttaaatgatgcttcatgcggctcccgacgccaaacatgctgcccaccgggagcggccacatttcggttttcatattttctttcgttaaggtaaaaataccgtttttattctttttggcaaaattgtcacacgcaattttggccagcgctttgttagggccgattccgacccgcgcataaacgccgatctcccgcatgattctgccctgaatgcttttcgcgatctccatcggcgtcccaaacagcttctggctgcctgtaatgtccatgaactgttcatcgatggaataaggctccacaaggtctgtatactcctcgagaatggccgtaatttgcagtgatacatcaatataccgctgcatacgcggccggagcacaacagcctcaggacacttttcctgcgcctcccacagccgtgaagcattcaccacacccttttgtttcgccagcgggcaggcagccaatacgactccgccccttttttcagggtcacccgaaacaatgacgggcctatttttcaaatgtggattttccgctttctctacagatgcataaaacgattgcatgtcaacgagaaaaatcactttttctttcatcatacacacctctaaaaagaacttatgttcgtttttcattatatgcgaaagtatgttcgttttatactggtaaatgattcttgtctgacagaaaatatgatccaagggtttgagagaagaaaaacatttagtagaataaaagcgaagcataaggataggagagtcatgatggagaaatttgtcgaaaaaatgatggaacaggcattgcggcaatacggcagaaacgttgctatagatccgttaagcccgtatgaaaaacaaagcctgaaagcggctctacaagagagacggaatgaagaaccggatgaggatttgcatgcgcatatagaagatatcatttatgactatgtcacaaaccaaggcttgttctcttaaacgcatgactgtcagttctttcagccgctgatgcggcttccccttgaaaacaccgcctgaaacaaataaacagtctcaggcttacagaaaaaaagcaggattttctcacgctccatagattcatatggcctggcgtaaaattcccctcaatgctcgcgcaaaacggaataagctgtccatgatcacgcgtatacactttttcgaagagatgtgctctcttgttctgtcatgcggtccatcggttttcagcttacatcttgatctcatagccggtttcactgccgatatgatctacgtcctggcggcttaaactnnnnnnnnnnnnnnnnnnnnnnnnnnnnnnnnnnnnnnnnnnnnnnnnnnnnnnnnnnntttcaagatgtaacccccgccacacgcatcctcaacgcatagtatattgccatccatacaatcaggcatactacatgtcaataacgaaatattttgaacgatctattggagaaggaaattttttcatatatgatagagaaagatcatacatacaggagagaatataattcatgaagaaatggaaagatatccacccgatcagctggacaattataatcggaaccattttcggcagaatggcaacatcgatgagcattccttttttagcgatttatttgacagccgtccaaggcgcatcagcttcctatgcagggctggtcatcgccgcgagctcatcagtcggcatcctcgcaagcttttacggcggatatatctcagataaattcggcagaaaaaacatgatgcttgtatcgattttcggatggatgctggtatttgcaggctttgcggcggcatctcacctctgggtgttttttgtagttaacgcattaaacggtctttgcaaatcactgtttgagcccgcttcaaaggctttgctgtctgatatgacagaagaaaaaacgagactgctagtttttaatttacgctatgcggctattaatatcggcgttgtcttcggacctgtgcttggcctatatttcggctcatcgcaatcgactacgccctttttggtgcctgcagtcatttacggactatacggaattgtgcttgccctccaatttaaaaaacatccatccttatcagcaccagcccagtcccgaaatatgagcgtgcgggaagcgtttatggtcacgcaaaaggattatctttttaccattgctttggtcggcattacgctatgcaccttcggctactcacaattgagttccacattccctcagtatatggcgcagagccccttgatcggcaatggaacgaagctgtatgggctgatgctgacattaaacgcaatcgttgtgttggcgacgcaatttcccattgtccattttgcaaaacggttttcgccgctttgttctctgatgctcggtaatgtgatggttagcatcagcatggccattttcaccgtatcgcacggtgttccatcaattgtgatgattgtcatcacatttacaatcggcgaagttcttttattctctatgatggatttatatgtagaccagattgcaaaaccaggattaaaaggcacttatttcggggcaatcggtttttcacagctcggaaacgtcatcggcccttgggtcggggggatatgaatagacctgtttggcgctgacaggccgatttttattttttctgtcctgagcggcattaccctgctcggcctgccatttttagcgttcgcctatcggcaaatgaaaatggagaccacaaaacaccgttctcgtctggaaaagccgctttaaataaaaaacggaagagaatgaaactctcccgcaaacatgaggtgaagaacatgaatataggtgatgtgatgtttcagctgtttgtatttattatatttgccgctgtcatctttgcggctgttacaggcttcaagtatgcgaaaaaccgaaaagcgcagctggatcgcattgagaaaaagctgaacagcctgtccgaagatcacgattaacagcttggggcaacgagctctaccttaatccggtctggatcctcacaaaagactgcataatgcccgtctcctccggcaaaagggtgcctgtctcggtacaacacacgatagccttttgccgtcaatttttcagtcatctgatcgacttgaagcttggattcagcatgaaatgcgagatggttcagaccgactcggcatctatggtattccggctctagaaatggctctttcgcctgcacaatcactaggtaaaaacgatctttcttccagctgatgcctgagctccatttttgatactctttatagccaagttcttttaagaaccagccccaaaaccgcctagacgcctctaaatcagagacatacagttcaatatgatgcacaatttcataccctccttaccagcacttcctcgaccttatgcccgtctcccttacgcaaaatgagatctgacctgaatttagtcggcaaaatattttcatataaattcggccggttgacactctcccaaatcgaggctgccatctcgtcagcctcctgatcggacaagtctttaaatttatgaaaatatgaatcaggattttgaaaagcagtttcccgaagcaggcgaaaacgctctaaataccaagtgaaaatccggctttcctccgcatccacataaatcgaaaaatcaaagaaatcggaaacaaaaatacgcgggttttcccggtcatcctccaaggtgggcgactgaagaacattaatgccttcaataatcacaatatccgcctgttctacaacctcgaacacaccttcctcgcggtcataggttagatgggaatacaccggggcctttacgctgtcctttcctgattttaagtcattcaaaaactcaagcagcgcctttacatcatagctttcaggaaacccttttctagacatcatatttttctttttcagctcggcagtaggaaataaaaaaccatctgtcgtgataaggctcacttttggacggtcaggcaaacgcgaaagcaacttctgcaagatccgcgccgtcgtgctttttccgactgcgacactgccggcaatgccgataataaacggaattttggctgaatgtgggtgcttcaaaaaaacattgacatgcttattgcgttcagccgcagacttgacatgcaaatgaagcaagcgaacaagcggaatatagatcgtttccacttcttcaacagatagataatcattcaatccttccacagcttttgcctcttcttcagatacagcaatcgacaaatgccccccaaaaccagaccaagactcccgattgtgctgtgtatataaagtatgtaagttaagttctttatttttcactgtttacacctgactctctgtaggttaaaacccttacaaagattgtaacggaaaaccttttcactgtctgcttatttttcatttcgtttctttagcaaatcagcaccaattcggttatacgcagccatttcatcttttggaaccatgcttcctcccgttccccagacgacatgtacggcatgttccatcttatatttctgaccatagcgccttccctcttctgtcgaaaaaagctgaaccggcccgaacatgccggcaagagcagagggctctaaatatttatcttcagatacagccagcatatgaagcaaagtataaagcgtattgtcctctaccgtataacagccactcagaagcggttcaatcagcttgccgacaaatcctgacggcctccctacggcaagtccgtcagcagcagtctgattatccaggccgatatcctggacggagattttctcgtgaagtcctgaataaagccctaacagcatacaaggtgaatgagttggttctgcgaaaaacacatgaacatgatctccgtataaaagcttcagcccaaatgctacaccgcccggtcctccgccgactccgcacggcagatacacaaacaagggcgtctcaagacttggctttatattcatacagtcaagctgtgtttttaatcggcttgcggcaacagcatatcctaagaacagctgtcgagaatgttcatcatcaataaaataacagaatggatcttgttccgcctgccgtctcccttcgttcaccgcttcgctgtaatctgtttcgtactccataacagtgactcccttttggcggaggagatcctttttccactgcttagcatcggcggacatatgcactgtcacgcgaaagccgagtgccgcgccgatgatgccgatgcttaaacctagatttcctgtcgaaccgacagcaatcgaatagcgggagaaaaaaccggtaaaccgctcttcctgtaagatgcggtaatcatcggtttcctgaagcattccttcttgaagcgcgagattttcagcatgctttaacacttcataaatcccgcccctcgctttaatcgatcctgaaatcggaagctcatggtcgcactttaaaagccatcttcccggaaatggctgctgatatgccgcttccagctttcccttcatatgctgcacctcaaaaagcggagactcgatgattcctttagcgcctttcgtctcaggaaacacctcggcaatgtaaggtgcaaaccgccgcattcttttttccgcttccgctatctcggttgcccactcatctgaacggggtattggcccctctttcttgcctgaatttgcccagaatacaggctctgcatcaatcagtttctgaataaacggatctttaagcagagcatgaaggacttctgaatgaactaacattcaacaatctctcccttccactatcaaaaactgcctcgttcgaatcaagccattccataacaggcagttccatattattttttcatgagcgcgcgtcctgccagcttttctacaagagctggaaacagctgatacagcttagtgccggcattcattaaacgcggaagattgatctcccgctttttcgtaaaaattgcagctgtaatttgagctgccacgtcatcaggatcaagcatccagcggccgacatttttggcgtagtccccgcctttatcagcaatggaaaaaaagtccgtctgaatcggtcccgggttgactgttgtcacataaatgccggttcccgaaagctccatccgcaaagcgtttgagtaacctaacacggcatgtttggtcgcggaatacaggctcgacttcggtgttgcgattttccccgcttgagaggcgatattgatgatatggccctttttttgctcaagcatttgcggaagcaccgcttttgtacaggcgatcaggccgaagacattcacatcaaacatcgctttcatgtcatccaatgtagagtctaaaaccgtttcaaatataccaaagcccgcattgttaatcagtacatcaaccgagccgatctgatcgcggacccgggcgatatcctctaggcggccgacatccagaggaaaaagctcacactgtccgctccattcctcggttattttccttttgatttctatcaaacgatcctcgcgtctagccgacagaaggacatgggctccttcagccgcgcataagtatgcgattctttcaccaagccctcctgaagcgccggttatccaaatcctttttcccgctatatgtttcacccatttcacctcttcattgttttaaagtatgcggtatttccttcccaatatgacgcgatggcttcttcagcctccaacacatcaaggtgacctgccgtttctgacatcgttaaaaacaattctttttcatatacagcaggaaaaagctgctgacagacctgaaaagcggtcatcggcttttcatccagcatgcgacgaacatcctccgtcctgttcctctgcttgtcaaaacgcttctcaatcagcgcttgtacactggtgataggctcgccgtgaccaggaaatacgattgttggatcaagttgagacagccttcgcaatgaccgctgataatccactaaaggctttgacctgacgtctcccgctttcggcgcttccaaaatcggattagacgagctgtttgccagcagtagatcgccgccaagcatccttccgcttttttcatggaacagaacgatatgcgattcagcatgtccaggcatctccaacacagaccagccctcaagcccatctatgttcataccttctctgattgattttgtcagagatctcgtacaggaaaatgcgtacgctgatcgaatcagcttttccgccttccccgtatcaaatggaacgcctaattcaggcagcagcttttgaaaaaaacgtttttgccaatccataaaggcttgatttcggctgatataaggttcgttgaacgcatgcccaatcacttcgatttcatctgaaaagacatcaagcaagcctgcatggtcagcatgatggtgagtcagtacaacctgctcgatatctgatattttcacatttacagcggcaagctgctcttgtagggctctggcagcctcttttgtattcggcccggcatcgataagtgtcagcgcatcaccttttacgaggtaaacgataacatcgccgacagcaaacggcgtcgggacgcggatcgcaattacatcttcagttgtcatcctttcgctccttgtcttcattcattattcatattttagctttttctcggtcttgtgtcattattgcagaatgagaacaaacctttttgaaaaagctattgacattagcttgtccgccattgcataatgaacaacaaactaaaacgagaaccattggaacgctatgacgaggaatagtatacaaggcaatggcctaagagagcgatacccccggctgaaaggtgttgcggcccgcttgtttgtagaacctgccctcaagtcgcggttaggaaaacctaaacgtttcccgcgttacggggatttgagctgagcacaatttgtgctaatgagggtggtaccgcgaaccttttcgtcctttacgtgatgaaaaggttttttgttgttctgatagaaggaggatatcaatgaaaaagataggatttgtcggcgccgggtcaatggcagaagcaatgatcaacggcattttgcaaagcggcatcacaaaaccagaacatatctatattacaaatcgctcaaatgacgagcgtctgattgaattaaaggaaacgtacggcgtgcgtccatgcagagataaaaatgagtttttcactcacaccgatatcattatcctcgctttcaaaccgaaagacgcggcggaaagcatcgacagcatccggccgtatatcaaggaccagcttgtcatttcagtacttgcaggccttaccatcgaaaccattcagcattattttggcagaaagctcgcggtcattcgcgtcatgcctaatacatcagcggcaatcagaaaatcagcaaccggattttccgtaagcacggaagcaagcaagaatgatattattgccgcaaaagctctattggaaacaatcggtgatgcaacactggttgaggagcggcatcttgacgctgtcactgcaatcgcaggcagcggcccggcctatgtgtatcgttatattgaggcgatggaaaaagcagcacaaaaattaggattagataaagaaacggcaaaagcactcattttgcagacaatggcaggggcaacagatatgctcctccaaagcggcaaacagccggaaaagctgcgtaaagaaatcaccagtcctgggggcactacagaggcaggtcttcgcgctttacaggactcccgctttgaagaagcaattattcactgtattgaagaaacagctaaacggagcgcagaaatcaaagaacagtttgccggtgccgccttagagagacattcttagatgtaaggacaaaaacagaaggcacagtgccttctgttttttatttttcccgcagcagctggccggcagattctgattgctttaatagcgcggagatcgtaaatgaaagcaaatcgggaagcacttcaaaggaataaggtatatacaatctttccgtccatttatgcgggtctttaccagccggaccgacatttaaaaccgggacatataaagcctgatttttaccgcttggcaatgaatatcctctgttaaagagcggcatattgcttgtgtatgcatcaacctcctgcttttccagctgaagataactcaagtccgaaagtccggggaagtactgaacctcccgtaatgcaatgccgtatcgctcagccgcataatgctttaactgatctgctgtatttctgatcaattgatcatcctttgaagaaacagctggataaagcggcggactataaaacagaacgatgagcggcgcatcctccttacaaagcgaagcaagctcagaaacaattttcgtcgaaaaatccctgtctccaagcccgcccctgttagcaaaggcataatttagagcccgctctgtttccgagatccccgcacgcttttttgcacgcgagaccagctcatcaaatgtcaaaacagtgacatcccgctcaatcggctgaaatggctcaaattgttgaaaatcctgtgttttcttccgaacgttcgacatgatttcctccgccgcctgttctgctgttttaagcagcatctgatgcagctcactagctgagcgtttcattgacagcacattaaataatgtgacagctgtatgcggtgtctggactgaatatgcctctttcaagtccttttgcattaagtttaccggcggcggagtgacctcgccatcaaccttttcgcaataatcagcattcagttcaagcaaacggttaatctcagataccattaaatttgcgtttaggcctgaaaacggctctccaacatgtgtctcaatccccttgcagaaaaaacccgcaagcacctttccaatgcttcctgtataaaaatattgctgctgatcgccgggaaatttttcaaacatcggttcggcattcaggcaagcggttaatgtgatatcatgctttttctccatttccttcaatgcaggaaccgcttcaatcatgcctcttgaattcacttcctcgtccggaaccgttatcaacagcagattgccctcaaaatgtccgttcattgccctctccagcatcgacagttgaacacaaagccccgctttcatatccatcgtccctcttccgaacagccagtctccgctttcagcatctcttctcacccgttccgggagcagctcttttttctctaaaaaggagctcaaaagctcagcaggcttgcaagccatatgtttaaattcgccgtaatcttctatgtcaacgacatcaaaatgactcagcagaagcactgtctttttgacattcttctttttgactagagccgtaagaaaagatctgccatcgtccatcggatgaagtgttacatcatcagggtgcttttgaaaatagggcttgtccttcaaaataaaataaagatactctgcaagcgctgcctcgccctttgaaccggtgatgctttcgtattgcacaagagaagttaaaagtgccagcaattcgtccttcgtctgccaattcattgattccgcccctcctatgaataaaaatgcttcaatactgaaaaataaactgatttctcgtctattatacagaaatgtttgacaaaagcggttcttttgagcagtttatatgacgggaaagaaatgacttgatataatcaatctctaaaaaccttacgggaggcgaaagaaatggccagaaaattatttacacctattacaattaaagatatgacgttaaaaaaccgcattgtcatgtcgccaatgtgcatgtattcttctcatgaaaaggacggaaaattgacaccgtttcacatggcacattacatatcgcgcgcaatcggccaggtcggactgattattgtagaggcgtcagcggttaaccctcaaggacgaatcactgaccaagacttaggcatttggagcgacgagcatattgaaggctttgcaaaactgactgagcaggtcaaagaacaaggttcaaaaatcggcattcagcttgcccatgccggacgtaaagctgagcttgaaggagatatcttcgctccatcggcgattgcgtttgacgaacaatcagcaacacctgtagaaatgtcagcagaaaaagtaaaagaaacggtccaggagttcaagcaagcggctgcccgcgcaaaagaagcaggctttgatgtgattgaaattcatgcggcgcacggatatttaattcacgaatttttgtctccgctttccaaccatcgcacagatgaatacggcggctcacctgaaaaccgctatcgtttcttgagagagatcattgatgaagtcaaacaagtatgggacggtcctttatttgtccgtgtatctgcttctgactacactgataaaggcttagacattgccgatcacatcggttttgcaaaatggatgaaggagcagggagttgacttaattgactgcagctcaggcgcccttgttcacgcagacattaacgtattccctggctatcaggtcagcttcgctgagaaaatccgtgaacaggcggacatggctactggtgccgtcggcatgattacagacggttcaatggctgaagaaattctgcaaaacggacgtgccgacctcgtctttatcggcagagagcttttgcgagatccattctttgcaagaactgctgcgaaacagctcaatacagagattccggcccctgttcaatacgaaagaggctggtaatgcccataagagatatcctgtagaggatatctctttttttatttttagagaaacgatcggctaaggttctccgtctccctagtagaaccaattagaggagatgactccaatgaaatcagcttggatggaaaagacatatacaattgacggatgtgcgtttcatacacaacaccggaaaggatcaagcggtgtaacgattgtctttgaggccggctatggtacttcttctgagacgtggaaaccattaatggcggacattgatgatgaatttggcattttcacatatgatcgggcaggcataggaaaaagcgggcaaagcagagctaaacgaacagctgatcaacaagtgaaagaattggagagtttgcttaaagcagctgatgtaaaacctccttatttggctgtttcacactcatacggagctgtcatcaccggtttatgggcctgcaaaaacaagtatgatattatcggcatggtccttcttgacccagctttaggcgattgcgccagctttacctttatacccgaagaaatgcacaaatcacatacgagaaagatgatgcttgagggcacacatgcagagttttcaaaaagtctgcaggagctcaaaaagcggcaagtccacttaggaaacatgcctcttcttgtgttgtcatcaggagaacggactgagaaattcgctgctgaacaagagtggcaaaacttgcacagcagcatattgtctctatctaaccaaagcggctggattcaagctaaaaacagctcccacaacatccatcatgatgaacctcatatcgttcacttggctatttatgacgtatggtgcgcagcgtgccagcaggccgctcctctttaccaagcagtcaattaacgtaaaaaaagaccgggccgtaagggattcccggtcttttatattattttgtttcacggtgaagggtatatttctataaacgcggtgaatattttttcagctccaaacggtctggattggtgcgtttattttttgttgtgatgtaatttcggtctcccgtttcagtgcaggctaaagtaacatttactctcatatttaacatctccttataaaacgtaataattacgttttattatacaacatcatcacaaattgtcaaataagagctctgccttcagcctcgcgggacgtttacctctaagaaatcatatgccgccacgctattggggaaaacgtcaaccgcttctttttgaagctccaaagaagcatctccctgatatcttgcgctgatatgggttaaaatgagctgcttcgctcttgcttctttcgctgttacagccgcttgttccgttgtactgtgataataatcataagcaagtttacggtcttccttagcaaaggttgcttcatgaacaagcacatcacaatccctcgcaagctcttttagtttgtcacttactctcgtatcaccggagaacacaacagatcttccctttttaggaggctccagaaaatcattcccattgatgattcgtccgtcttcaagcgttaccgtttcgccttttttgattttctgatatacaggtccgggcgggatgttcatttcttttaatacatcagcctttaaggaacccggtacgtctttttcctgcacacggtacccgaaggcttccactccatgaataacagataccgctgtgacaataaactgatcgtcctcaaacacgattccttcttcaatttcctggaccgcaagcggatatgtcaaatgggtcttcgtgacggcaaggcttgtttcaataaacgccttgatccctttaggtccgtacactgtcagctcgtcctctccgccttgaaaggaacggctccccagaagccccggaagtccgtatacatgatcgccgtgcatgtgtgtaataaagattttctctattttacgaggtttaatcgttgtatgtaaaatttgatgctgtgtggcttccccgcagtcaaaaagccataccgaacgcctttcttcaagcaatttcaatgctacagaggtgacgtttctcgccttggcgggaatgccggctcccgtccctaaaaaaagtaattccacgtttccttcctcctactagaaccagatacctacaagaatacaggatcaagctcaaaatgtgaatcttgcctctgaaaagaacaatcctttcgtgctagaaacattttttcagcattctgcttaaaaaagggcttaaatgtttgctttcgttgaattttagatttaaaatgaaggaaatatacggggtgtactaaaataaagcttcgaataaagtgaggtacttttagtgaaaacaaaccaacaaccaaaagcagtaattgtcatattcggtgcaactggagatttagcaaaacgaaaattgtatccgtctattcaccgtttatatcaaaacggacaaatcggagaagagtttgcagtggtaggagttggaagaagaccttggtctaatgaggatcttcgccaaacggttaaaacatccatttcctcatctgcagataagcatatagatgatttcacgtctcatttttactatcacccgtttgacgtgacaaaccctggttcttatcaagagctaaacgtattgcttaaccagctggaagatacatatcaaattcctaacaacagaatgttctacttggcaatggctcctgaattctttggaacgattgcaaaaacattaaaatcagagggtgtaacagctacaaccggctggtcccgccttgtcatcgaaaaaccgttcggccatgatctgccaagcgcacaggcattgaataaagaaatccgcgaagcatttacggaagatcaaatttacagaatcgaccattatctaggcaaacaaatggttcagaacattgaagtgattcgatttgccaatgcgattttcgaaccgctttggacaaaccgctacatttcaaacattcaaatcacatctagcgaatcactaggcgttgaagaccgcgcaagatattacgaaaaatcaggcgcccttcgcgacatggtgcaaaaccatattatgcagatggttgcccttcttgcaatggagccgcctatcaaattgaacacagaagaaatccgcagcgaaaaagtgaaggtgctgagagcactgcgtcctattgcaaaagacgaagtggatgaatactttgtgcgcggacaatatcaagctggtgaaattgacggtgtaccggttccttcttatacagaagaagataatgtcgctcctgactccaatacagaaacctttgttgccggcaagctcttgattgacaacttcagatgggctggtgttccattctatatccgtacaggaaaacgaatgaaagaaaagaccacaaaaattgtcgttcaatttaaggacattccgatgaacctgtactacggtaatgaaaacaacatgaatccgaacttgcttgtcattcatattcagcctgacgaaggcattacgctttacttaaatgctaaaaagcttggcggagcagcacacgcacagccaatcaaactcgattattgcagcaattgcaatgacgagttgaacacccctgaagcatatgaaaaactaattcacgactgtcttcttggcgatgcaacaaactttgcacactgggatgaagttgccctttcttggagctttgtcgactctatttctgaaacatgggcagcaaacaaaaccttatctcctaactacgaatcaggctccatgggaccgaaagaatctgatgatcttttggcgaaagacggcttacactggtggaatatataataagaagaaaaaagccgaaaatgtttacaagcattttcggcttttttacgctgaacaatctctttaataacaaaacccccaaagcttaagagcttcgggggtttctattgattacttcatccattcagtatggaagatgccttctttgtcagtacgctcatacgtatgagcgccaaagtagtcgcgctgtgcttggattaagtttgcaggcagtacggctgtgcggtagctgtcatagtaggctaatgcgcttgagaatgatggcaccggcacaccctgggcaactgcaagtgaaatcacttggcgaagcgctccttggtagctttctacaatattcttgaaatagctgtcaagaagcaggttgtcaagctcaggctcgcgatcgtaagcttctttgatcttctgaaggaatgccgcgcgaatgatgcagccaccgcggaagatcatagcgatttcaccatatttcagatcccagttgtattcttcagaagcagctttcatttgggcaaatccttgcgcgtacgagcagattttactcatgaacaacgcttttctgaccgcttcaatcagctcttctttattttctgtaacaggcttcacttctggtcctgaaagaaggccgctcgctttcacacgctcttccttcatagctgagataaagcgcgcgaatacagattcagtaataatcggaagcggaacacctaagtcaagtgcgctttggcttgtccattttcctgttcctttttggcctgctttatcaagaatcacatcaacaagcggtttgcctgtttcttcgtcttttttcgtaaagatgtcagctgtaatctcaatcaagtagctgtcaagctcacctttattccattcagcgaaaacttcgtgaagctcatcagcagaaaggcccagcacctgtttcagaatgaaatatgattcagagatcagctgcatatctccgtattcaattccgttgtgcaccatttttacgtaatggccggcgccgtccggaccgatatatgtcgtacaaggttctccgtcaacttttgcagaaatggcttcaagaatcggttttacaagctcatgtgcttctttttgtccgccaggcatgatagaaggtcctttaagtgccccttcttctccgccggaaacgcctgttccgataaaatgaatgccgctttcagcgagttctttgttacggcgctgtgtatctttatagtatgtattaccgccgtcaattaaaatatcatccttctctagatgaggaagaagagattgaattgtcgcatctgttgcagttcccgctttaaccattaataagattttgcgcggtgtttccaaggattggacaaattcttcaatgctgtaagtgccaacaacattttttccttttgcctcctgtaaaaactcctcagttttactgcttgatctgttgtaaacagaaacagaaaatccccggctttcgatatttaaagccagatttttacccatgaccgcaagtccgataacgccgatttgttgttttgacatattctaacgtcccttctgcaaacgtttaatcattttaaaatttaaattaaaataaaatgatatttataataaagaaattaccatacattcaccctttttttcaagcgattcagcttttcttttcatcatgaaaaaaatctttattaaagcttgttccctttgttttgctctcctctttttttaacgttgccccttttctgatcagtttggtaccgtactttttattcagcttttccatcatctgctgaataggctcatccttcgcatcttcattaaagctgaacaaatcgagctgtttataggcctgctctttttctactaaatccgttccggtaatgccaagcagcctgacaggatttttattccagtgtttaaaaaagaggtgctccgcttctttcaaaatgtcatttttttgatcaatcgggtttctcagcgtggtgcttcttgtgatggttttccaatccgcatatctaatcataataaaaagcttcgaagccatgacttccttgcgctgtaaacgggcactcacagaagcggcaagctttctaaagacgcctaacagctcttcttcatcactggaatcatgggaaagtgtcgatgagttgccgacgcttttaaattcgtaaatgcgctccgggtcaaccggcgcatggtgaatgccatttgctttatttttaaggcgcggaccgtttatgccaagcaggcgtttcagggagtgttcatcagctgcagctagctctccgattgtatggatgccgagtcccttcagtttttccgctgtctttttaccgactccgtgcatctctccaacaggaagcggccaaaggatgtcgggcacttgcctctttcttaaaatcgtgattccaagcggttttttcatatcagacgccatcttagcgagaaatttattcggcgcgattcctatgcttgacggaagcagcagctctttttgcaatctgctttggatttcttttgccgtctccagagcccggctgctgtatggtgtatcggtcatgtccatatagccttcgtcgatggagacaggctccaccaggtcagtatattcacgaagaatggtaaacatcgctcgtgaagagtttctatagcggtcaaagttcggcggaagaacgatgagctcaggacaatggcgcttcgcttgccaaaccggcatcgttgttttgacgccgcgcgctcttgcttcgtaactgcatgttaccacaatgccctttcgctcctttacgtttccggcaactgcgaccggctttccccggagagccggatcatatgccatttcaaccgacgcataaaagctattcatatcaatatggaaaataattcggctctttcccggcataaacaaatctccttttcggtcattagacaacagcttgtacatatagtaaaatgaagctattgaatggatgtgatgacaatgtttgtggaatcgataaatgacgttttattcttagtcgattttttcacaattattcttcctgctctaacggcaatcgggattgcatttctcttacgggagtgccgtgcgggcgagcaatggaaatccaaacgaacagatgaacatcagacggtctttcacattaaccgaacagactttcttattattatatatcatcgcattacaacttggatacgtaaagtcttccgcatgaattcgcctgtgaacgatgaggaagacgccggttctcttcttttataaaccgcatttataaaaaggaggagaacaaaattgttaaaaacatatcaaaaacttttggctatgggtatctttttgatcgtattatgctcgggcaatgctgcatttgcagcgactaatcaggtgggaggcctcagcaacgtaggttttttccacgattatttaatcgaaccgttttccgctctgcttaagggtgttgccgggctgtttcacggagaatacggactctctattatcctcgtaaccattattgtgcgtatagttgtattgcctttgtttgtcaatcagttcaaaaaacagcgcatcttccaagagaaaatggccgttattaaacctcaggttgacagtatccaggttaagttgaaaaagacgaaggaccctgaaaagcaaaaagagctgcaaatggaaatgatgaagctgtatcaggagcataatatcaacccacttgcgatgggctgtcttccaatgctgattcagtctccgattatgattgggctttattacgcgattcgctcaacacctgaaattgcgtcacactcgtttctatggttcagtttagggcaatctgatattctcatgtcccttagtgcagggattatgtattttgtccaagcctatatcgctcaaaaactgagcgcgaaatattccgctgtcccgcaaaacccagcggcacagcaatccgcaaaattgatggtgttcatcttccctgtgatgatgacgattttctcgcttaatgttccggcagcccttccgctgtactggtttacaagcggactgtttttgacagtgcaaaacatcgtccttcagatgacgcatcataaaagtaaaaaaacagccgctcttactgagtcggtgaaataaaaaaacaaccccgcgcgaaaagccggggttgttttttgttacttgcaaagcataccgcgccaaacagtcttgtttatcatggctgaagcagaaatggccatccaaaaaatagccgtatcgtttaaaaagaaggaaatagggaatacctttactcatctccaaacgaaaggagcatatacgttgacggaacactttcagcaaaaaaacatttctgtacctgaaggaatctggatcatgagacaaacctggaatgatgtcttatttgctcactggcctgttgatgtttctatccttcgcgctttggtaccgtccgttttagaattagatacatataacgggcaagcttggatcagcatgcttccctttatgctcacgaacctgagggcgcgttatcttcctgccattcccggtgcgcgtgcatttcctgagcttaacctccgcacctatgtcacgtataaaggtaagcccggcatttatttttttagcttagatgccgatcatcgtctggcggtccttggcgctcgcacattctttcatttgccttatttttacgcggatatgaaagccgaaaaaaacggtgatgccattgactatgtcagcaagcggaaagatgacaaagaagcagcattccacgccgcatatcggcccatttcagcgccttttacagcagaaaaggattcgctcgattactggctgacagaacgatacaggctctacaccacttatcgcaataagctctattacgaagacatccatcatcatccgtggctgctgcaaaacgccgaagcagaaatttcagtcaatacggtgactgatgctcacggcattacattgccggagtcagaccccttgcttcattacgctaaaaaacaggatgtgttattttggccgcttaggaaatggagctaaaaaaacccgatgcgggaaatcgcactcgggttttctttttttattttgccgcctcttcaataatggcaacaaccatttctgccgttttaacgagctcttcgatcggcattttttcattttttgtatgaatttgctcataaccgacagcaagattgaccgtcgggatgccatgaccagcgattacgttcgcgtcgcttccgccgccgctcgtttgcagctcgcttggacgtccgattttagcagccgcttttttcgcgatttcaacaacttggtcgccgtcttgatatttaaagcccggatacataacctcaatttcgacttctgcgcgtccgcccatatcagcagctgcctcttcaaaagcagctttcattttttgaacctgagcttccattttctcaggaactaaagagcgcgcttcagcaagaatatgaacttcgtcgcacacaatgtttgtttgtgtgccgccttcaaaccggccgatattagctgttgtttcttcatcgatacggcccaatggcatttttgaaatggctttgctagcgattgtaatcgctgaaatgcctttttcaggttcaaccccggcgtgagcggttttcccgaaaattgccgctcttaccttcgcctgtgtcggcgcggccacaatgatatttccaacttttccgtctgaatcaagggcatagccgtaggatgcagtgatcatagaacggtcaagagccttcgctccgatcagacccgattcttcccctactgtgatgatgaattcaatcgtgccgtgttcaatgttttcttctttcagcaccttaatcgcctcaaacattgcagccaatcccgctttatcatcagcgcctaaaatcgtcgtgccgtcagttttgacgtaaccgttctctacaactggttttacgccgtttccgggtacaactgtgtccatatgagatgtaaaatagatcgtatctgtttgttttgtcccttttagcgtgcaaatcaggttaccggctccgtggcccgtgatatccattgtatcgtcttctttaacgtccacacctaaatcagaaaattttcgtttcagcactttgcagatttcagcttcgtgctttgtttctgagtcaatttggacaagctctaaaaattcttccagcaggcgtttttcattcaccatttgtaagtccctccatgttaaagcggtatgttaccgtgcttttttttcggtctctcttctgtcttatgtgcaagcatatgaaaagcttgaatcagtcttccccttgattcttccggcaaaatgatgtcatcgaccattccacaagcggccgctttgtatgggccggcgttttgctttttgtattcagctgttttttcgcgtttcgtcttttgcgggtcagctgaagctttgatttccttttcatacaaaatcgatgccgcaccttctggacccatcactgcgatttcagcattcggccatgcaaacacaaggtccgctccgatcgctttgctgttcatggccacataggcgccgccgtacgcttttctaatgatgagtgtgacttttgggacagtagcttcagcataagcaaacaataattttgctccatgcctgatgattccattgtgctcttgctgaatacccggcagaaaccccgggacatcttcgacagtcaatagcgggatatcaaatgcgtcacaaaaacggatgaaccttgctgctttatcagcagcgtcaatcgtcaggcttcccgccagatgcttcggctggctcgccacaatgccgattgctttttcacccagccttgcaaacccaatgacaatgttcttcgcaaaaaatggctgaatctcaaaaaaagactgcgggtcggccatctccttaatcaccgtccgaacatcatacggctttgtcgtgtcagcaggcactagacggtttaataacggtctggacgcctctttctctggcttcggctctgttgtccggccattcagcggcaaataagacagcagttttctcacccctgtcagaacctccttctccgtatgcccggaaaagtgggcgtttccgctgacggcattatgtatccccgctccgcctaagctctccgcatcaacctgttcccctgtcactttttcaatcaccttcgggccggtaataaacatccggccggtctgttcagccataaatataaaatctgtgagtgccggagaatatacagcgcctccagcgcacggccctaaaataaccgatatttgcggaatgactccggaatataagacgtttcggtaaaatatgtgaccgtatccatctaatgataccacaccctcttgaattctcgcaccacctgagtcattcagcccgataatcggcgccttattttttgctgccagatccatcaaagcgcagattttcctggcatgggtttcgccaagcgcccctccgtacactgtgaagtcttgcgcaaatacataaactgagcggccgtcaattgtgccgtaccctgtcacgaccccatcccctaacatgcgctgttctcttgttaacacttgactttccatgaaggggtgtaattcgataaagctgtcctgatctagaagaaatatgatcctttcccgagcagtgagcttgcccttttgccgctgctgagccagcttttcccgtcctccgccttcttctgcctgcttgcgtttcgtgtataaatgatccatgtgctcattcatgctcattgtgttggtctcctttcggttcacaaagctctataagaacaccgtttgtttcccgaggggaaataaacgcgatctttttcccatttgccccctgtcttggatacctgtcaatcaatcgaacatgccggtcagacaatgcttgaagctgttcagataggccgttgcacaaaaacgcaatatgatgcagtccctgccctttcttctccaaaaataaacggacggggctgtcagctgtcaacggctctatcagctcaagtttgacgctaccagcttgaaaaaaagcaacattcaccttttgttcttcaaccgtttcttgatgtagaaatgcaagccccaatacattttcataaaagcttctagcatcttttatcgaaaaaacggctatcccgatatggtcaagcctgttcatttgcatccctgctttcgctaatagatatcgcttgtccacccattcaaaacacgctaaaatatagacagattgtttaaggagtgaaaatcatgtctcaaaaactgatgaaaagcgttttgatcgtgattttgggagtttttattctttcaactgtactctcaggaatcgtcatgtttttataacgataaaaaagcaggcgccttattcaatgggaatatcctgcttttttatcagagctttatgctcgatggcaatctcctcaaaagagcggttgtcgtccgtgatcagcactctcgttcctactggtatcgtttgaaacaaatgaacgacctcatcgttatgcatacgtatacagccgttagacacaaatttccctactgattcctctcggtttgtcccatgaattccataaatccgcccgtccgttcctttcgcgtcaaatccgatccatctggccccaagcgggttgtcaggagatcccccttcaatatttttctttctgtagtaaggattttccgcttttaccgttaccgaaaactctccttcaggcgtcaaatcatctgtttttccagtcgccacactatacacgccttctactctgttgtcgaggataacagcaagttcatttgttcgcttgttgacaataatatacggatcacccggcagcggattttcgccgagcggccaaatcggtgaaatcatcataaaaatcgaacataagaaaaaacgcataagctcctcctttttcattaggttgaccaatgaaggaagagctcatgcgaatcatccgagtgatttttgtgcttttattcctttaaaataacttttaatcactaaatattgttccatttcgccgagaagatggaagagagcggccctcgcttcaaattcctctctagtcgcaggaagcggcatctcctcaaattcttttctcatgtcagcaagtcttttcagaaatttgtacgctgtattcccagggtgtatcgcctcccgcaaatcatgaataaattcagcgatcatttttccctgatctaccgtaatggagatcgatgtcactttagggagaaggcgttcgataatttcaaattgcttttctctcattttaaaataatgataatgcagattttcataacgcaaaatgtggttttgcacatctcgatatgccaggtttttagcctccgtaatgagctggtgcgtttccggaatttcttttcctgaccaatcttgctcaccagttaacaaataccgttcgatttctgcaaaaatgacagcaaagttatcctctatctttttgcggtaggcaatcagtttccggtcaagactaggcatatacaagttcatcaatagagcgacgccgatgccaaccgtaatcagctgaacttcattccagatgaaagcaagcgtaatgccgccggacatgtataaatgaaggataataacggaactggtgacgataccttcgttaatttttaacagaaccgttatcggaatgaatatcaaaagaagcgctccgataacaaacgggtggtagccaataagctcgaaaaagagataagaaaaaacaattgccagacaacatgccgcaaagcgggcccatgaggcctgaagcgaccgtttttgtgtgatttgtatgcacaaaatggtgatgattcctgctgatgcgaagttttgcaaatgcaataactggcttatataaatagccaaagctgttcctagcgcggtctttattgtgcgataaccaattttaaacatgtcggactccatttctatttgtttcttcaataaaaaagaagaggcggccagccttcttcttttttatattctataatattttctctaaaaagtcctgcgctcttttggattttggcgacataaaaaattccttcggattgccgtcttcgacaatcattccttggtccataaacagcacacggtctgccacttcttttgcgaagcccatttcatgtgtgacaatcaccatggtcatgccggtttcgaccagctctttcatcacctgtagcacttctttgaccatctccggatcaagggcggaggtcggctcgtcaaacagcatgatgtccggattcatcgcaagagccctggcaatcgcgacacgctgtttttgtccgccagacaaacggtttggatagtcatttcgcttttcaaacaaaccgactttgcggagcaggtcctcagctttctcctgtgcagcctgttttgattctttttttacattgacaggcgcgtacatgatgttttcgagaaccgttttgtgcggaaagagatgaaaatgctgaaaaaccatcccgatgttttcccggacctttaatgtgttggtttttggcttcgtaatctctgtgtcttttattgtaatggttccgccgttaggcttttccaacaggtttaaacagcgtaagaacgttgatttgcctgagcctgaaggaccgatcacggcaacaacctcaccctcagcgattgttgttgaaatgttttttaatacttcgtgtttcccaaatgattttgacagcttttcaaccttaatcattggatttcagcttcctttctacagccttgccgataaacgttaaaatcaggacaagcacataataaatcaatcccgcgataatgagcggctcaaggtaattgtaagtggcggcgccagcttgatatgcgcgtctcatgacatcaccaagcccgatgacggtaacgatcgccgattcttttgttaacgtaattaattcattcacaattgcaggtgatatatttttgaaggcctgcggcagcagcagatccttcatcatttttccatacgggacaccgagtgcaacagcagcttctttttgccctttatcaatggcattgattccagctctgataatttccgatacataagcggcggaattcaaagacaatgcgacaaccgcagcccaaaactggtcaatttgaaatccgagcagctgaggaaggccaaaatagacaatcataagctgcagcactaaaggcgtgcctcggaacactgatgtataaaaatcagcgatccagataaacgggcggaatgtgctgatcttgcataagcttagcacaataccgagtataagtccgataatagcagatacaacaacaatttttaatgtaattgccaagccttctaatataaaaggaatttgggggatcgttgctgaaaaatccaaattcatagcctttgtctccttttcttacaggaaaaaagatttcctattcaataaaaaggctcaacgaaaaagttgagccgctttttttacttctcgccagtgaaccattttttcttcaatttctcaagctctccgttatcttccatttccttgagcgctttattgaatttgtctgtcagttcactgtcctttctgaaagcaattgctgaaccggcttcttccgctttcgcatcaggaatcacaaagccttgcaggtcatcatttgatttaaaatacccttctgcaacaatgtcttcaataatcgcggcatcgaagcggtcagatttgatttcctgcaccaaatcagaaattctgttgcggtcttctgttttaaaaccatattccggagaaagctctttccccttctcttcctgaatagagccaagctgaacgccaactgtttttcctttcaggtctttcaaagattgaatgccgctgtcttttttgctgacaatcatatggttcgctgtgtaatacacatcggaaaaatcaacttgttttttacgctcaggcgttggtgtcattcctgacagaacgagatccacctgttttgatttaagcgctgtaattaagctgttgaagtccatatcctgcacttcaatttcatagcctgccttctttgccagagcttttgccagctctacatcaaagccgacaatattatctccttctttatattcaaacggtttgtaatccgccgaagtacccataattaattttttctttccgctttctgaacctgaattgcttgagccgcacgcagttaatgcaaaggtgatgcaagcagctacaagtaataagagccattttttcatgatccatttcccccgtattcattacttttggtgtatttgaatatttattcgttaatttgtattttaaacagtttctcatttttatgcaatactatttttaaaaattatctttaagcttatctttccagtgatctcttctgatattactagataaaaattaaatcactatacaatccgattgaataaccccttaatatttattcatatatccttggaaatttatgcacaaaaaaacccgggccgcttgggcatccgggttgtttgtcttatacttcctcacaatattcttcaaaggcttcctgcagctttgccactacggccatcggctcgtggccttcaatttcatggcgctctaccattttcatgatctttccgtctttcaaaatcgcaaaggacggagaagatggcggatatccttcaaaatagtcacgcgcacgcgctgtcgcttctttatcctgcccggcaaaaacggtgacgagctgatcaggtcttttatcatagtgaacggaatggtaggctgccggtcttgcaattcctccggcacatccgcaaacagagtttaccatgacgagcgtcgttccttttttcgtaagtgccgcgtctacctcttcggctgttttcagctcggtgtatccggcagctgttatttcttgtctcgcttggcggacaatatcattcataaataaattaaagtccatgttcaatgaagacctctcctttttcatcatctgttcttatgatagcaaggaaacgtccatatcggcaaatgactttgcttcgccgtgcactttttttgctcttcgtttactgcttacagaaaaaggggattatataaccagaagtaaaataaaggagcagttgtatatgagccacaggaaagcgttactgattcataacggaaatgccggcaacaaaaatatagaaaaagcacttggtgctgtggtgccggttttatctcaccatttagatgaggtaattattaaacagacaaagaaaaaggatgacgcgcatcatttttgccaatccattgatgattctgtcgacaccgtcttcattctcggcggcgacggcacgatccatcaatgcataaatgctatcagcgctatagaaagaaaacccgcggtcggaattttgcccggcggcacgtgcaatgacttttcaagagtgcttggcatccctcaaaatcttgcaaaggccgcggaagcacttatgtcaggaaaaaaaaccagcgtagacgtatgtcagatgaatgaccgttattttttgaatttctgggggatcggcttaattgcagaaacgtcgaatcaaatcaacgaaacggaaaaagcattattgggaaaaatcagctattttacaagtgcattgcgaaccgtctcatccgctgcatcgtttccgatgacattaaaaattgatggagaagaaattaaagaagaagccgttatgctgcttgtgatgaatggccaatacattggaacgaatcgaattcctctgcccgatgccagtattgaagacggcttacttgatgttctcatatgccgcaacaccaacctcactgcgttgcgggagctgatgagcatggaacaaggctcaattgatcgttttaccggagagctttcctatgtccaggcttcccgtatcgagattgaaacagacactgccaaaaaggcggatatggatggagaagtttatacacatacacccgcagtcattcaggtcctgccgcagcatatcgacatgcttgttcccgcaaatgaataactgtcatagggctttagaaagattttgcaaatccgttgactctcccctaggaggaggtcttacagtataagggatacacacttgaaaaaggggaagtcatatggagaagaaaaatattaccttaactatattattaaccaatttatttattgcttttttggggatcgggcttgtgattccagtaacgccgaccattatgaatgaattgcatttatcggggaccgcggtcggctatatggttgcctgcttcgctattacacagctcattgtctcaccaatagccggacgatgggttgatcgcttcgggcgcaagatcatgatcgtaatcggcctgttgttctttagtgtgtcggagtttttgttcggcattggaaaaacagttgagatgttatttatctcccgtatgctgggcggtatcagcgctgccttcattatgcccggggtcacggcttttatcgcagatatcacgaccattaaaacacggccgaaagcactcggttatatgtcagccgctatttcaacaggatttattatcggccccggcatcgggggatttttagcagaagtccattcccggctgccttttttctttgcggcagcttttgcactgttagcagccattttatcaatcctcacgctgcgcgagccggaacgaaaccctgaaaatcaggaaataaaaggacagaagacaggctttaaacggatttttgcccccatgtatttcatagcttttctcattatcttaatttcgtcttttggtttagcatcatttgaatctttatttgcattattcgtggatcataaattcggttttacggccagcgacattgccattatgattacaggaggagcgattgttggcgccattacgcaagtcgtcttattcgaccgcttcacaagatggtttggcgaaattcatttaattcggtacagcttaattctctcgacgagtctggtattcttgctgacaacggtacattcatatgttgcgattctgctggtgactgtcaccgtatttgtcggatttgatctcatgcggcctgcggtaacgacttacctgtcaaagattgcgggaaatgaacaggggtttgccggcggtatgaattcaatgtttacaagtatcggcaatgtattcgggcctattatcggcggaatgctgttcgatattgatgtaaactatcctttctactttgcaacggtcaccttagccatagggattgcactgaccattgcttggaaagcgcctgcacatcttaaagccagcacgtgataagaagcgcattctttgtgtactgcaaagaatgcgcttcttctttatactgatgatagaaggagtgatggcatgaaggaatcatattactcaattggggaagtttcaaaactggcaaacgtgtcgattaaagcgctccgttattacgataaaattgatttatttaaacccgcctacgtcgaccgggataccagctaccgctattatacagattctcagctcattcatctggatttgatcaaatcattgaaatatatcggcacacctttagaagagatgaaaaaagcacaggacttagagatggaagaactgtttgctttttatacagagcaggagaggcaaatcagggagaaattagactttttatcagcactggagcaaaccatttcattggtgaaaaagcggatgaaacggcagatggaatatcccgcactcggtgaggtatttgttttagatgaagaagaaatacggattattcagacagaggcagaaggaatcgggcctgaaaacgtgctcaacgcctcctacagcaaattaaaaaaatttatcgaatcagcagatggatttacgaacaatagctacggcgctactttctcttttaagccctacaccagcattgatgaaatgacttaccgtcatattttcacgcctgtattgacgaataaacagatttcatcaattacgccggatatggaaatcacaacgatccctaaagggaggtatgcgtgtatcgcgtataatttttcgcctgaacattattttctcaacttacagaagcttatcaagtatatcgcagaccgccaattaacagttgtcagtgatgtatacgagttaatcataccgattcattactcaccgaaaaaacaagaagaatatcgtgtcgaaatgaaaatatgaatcgctgaataatagaaaaagagcattttttgaaacaaaacttcaaaaaatgctcttttttcttatttagtaaacagatgtcttctcgtcaatcgattctaaaatttgtttcactcgtccgaggaatcgtccgcacacgagaccgtcaagcactctgtgatctaaggacagacacagattaaccatgtctctgacagcaatcatgccattgtccatgacaaccgggcgtttgacgatggattctacttgaagaatcgcagcctgagggtagttgataatgcccatcgactgaacagatccgaacgaacctgtgttgttgacggtaaacgtgcctccctgcatgtcatctgcagtgagttttccgtcttttacttttttagctaggccggtaatgtctttcgcaatgcctttaattgttttttcatcagcatttttaatcaccggaacaaataaagaatcctctgtggcaactgcaattgaaatattgatatcctttttctgaataattttgtcccccgcccacatgctattcatttgcgggaattcttttaacgcctgagcgaccgcttttacaaaaaaggcgaagaacgttaaattaaagccttctgtcttcttaaaggaatcttttatactgttgcgatatgcaaccatatttgtgacgtcgacttccatcatcgtccaagcatgcggaatttctgttttgcttcgcttcatattggaagcaattgcttttcttacacctgtgacagggatttctttatcaccggctgcagacgcaggatatgacgtctcttcttttggctcaggttttgatgcagacttcggtgcaggagctgctgttttcggctcctcagccttctgttcttgcgcgccgcctgtttcaattatgcgctgaatgtcttttcgtgtaatgcgcccgccggcacctgttcccgtcactcgatcaagatcaatgccgtgctctccggccaaacggagtacagctggcgagtagcgctttttattgggctgatcagctgattcggcactttttgcagcaggcgtctcagctgtttctgcagcagctggctgttcttgttttagttcagccggattcgcgccttctgtttcaattttgcaaatcacttctccgacttgcagggtttggccttcttctcccacaagctctgttatcgtaccagtaaaagaagacggaacctctgcatttaccttatccgtcatgacttccgcgatcggatcgtatttgttcactttatcaccgggggcgacaagccatttgctgatcgtcccctctgttacgctttctccaagctgcggcatcgtcatttgttcaattgccatgattgtatcctcccttacgtctttaaaactccgctaattctctcatcgccgcttccactttatcaggattgaccataaagtatttttccattgtcggcgcataaggcatagccggaatatcaggacctgcaagccgtttgatcggcgcgtctaagtcgaacagacaatgctcggatataattgcggctacttcgctcatgatgctgccttcttttgtatcttctgtgaccaaaagaacctttccagttttggacgcagcttcgatgatggcttctttatcaagcgggtaaactgttcttaaatccaccacatgcgctgaaatgccatctttttcgagacgttctgcagcttgtaaggcgaagtggacacacagaccgtatgtgatcactgtgatgtcgtcgccttcccgttttacgtccgccttgccgattggcaggacataatcatcagccggaacctctccctttatcagacggtacgcccgcttgtgctcaaaaaacagcactgggtcttcgtcacgaactgcagcttttaatagacccttggcgtcatatggtgttgatggcatgacaattttcagtccgggctggttggcgaaaattgcttcgactgattgagaatgatacagggctccgtgcacgcctccgccgtatggcgctctgacgacaatcggacagctccagtcattgttgctgcggtagcggattttagccgcttcagaaataatttggttgactgccggcataatgaaatcagcaaactgcatttcagcaatcggtctcattccgtacattgccgctccgataccgactcctgcgatcgcagattcagcaagcggcgtatccataacgcgctcttccccgaattgttcatagagtcccgctgtcgctttaaacacaccgccttttcttcctacatcttccccaaggacgaaaacgcgagaatctcgttccatttcttctttcatcgccaaattgattgcatcaatatatgacattactgacatttgttcttcctccctacttcgcatacacataatcaagcgctgactcaggagctgcataaggggcgttctccgcttcatccgtcgcttcatttacgattgccataatttcatccagcatggtttgttccatctcatcggacagcaggcctgtttcctttaagtaagcttgataagtaagcaggggatcactttttttcgcttcctctacttcttcacggcctctgtagctgctgtcatcgtcatcactggaatgtggtgtaaggcggtaagaaatcgtttcaattaatgtcgggccttctcctctgcgtgccctttcgcgtgcttctttgaccgcttgataaacttccagcggatcatttccattcacagttacgccaggcatcccatagccaacggcacggtcggaaatgttctcacatgcgacttgcttatcgtaaggcaccgagattgcgtatttgttgttttcacacatgaaaataaccggcagcttatggacagcggcaaagtttgccccttcgtggaaatcgccttggtttgaagacccttccccaaatgtaacaaaggctgcgatatcctttttctccatacgtcccgcaagcgcaataccgactgcgtgcggcacttgcgttgtaaccggagatgatcccgtcacaatgcggtttttcttttgtccgaaatgtcccggcatctggcggcctcctgagttcggatctgctgcttttgcaaacccggacatcattaagtcctttgctgtcatgccaaacgcgagcacgacacccatgtctctgtagtacggcaatacataatccatttcacggtcaagtgcgaaagccgctcctacctgtgctgcttcctgtccttgacaagaaattacaaatggaattttgccagaacggtttaacagccacattctttcatcgatttttcttgctaacagcatggttctatacatatcaacggcttcctgatcagtcagccctagtgcttgatgtcggtttgtactcattcaagcccctcctttatgcttttaaaaatgaatggctttgccatctgcggcaagcgctgcttccccaattgcttcagaaagcgttggatgcgggtgaatcgtttgcccgatctcccacggcgttgcgtccagcactttggcaagacccgcttcagaaatcatgtcggtgacatgcgggccgatcatatgaacgccgagaatatcatctgtatctcggtccgccacgattttgacaaaaccgtcgctttcaccgtatacaagcgcttttccaatcgccataaatgggaacttgccgattttgacattatgcccgttcgcctttgcttcgtcttcggttaagccaacactggcagcttcagggcttgagtaaatgcacttcggcacaagcgtcggatcaagcggatgcggattgagacctgcaaaatgctcaacagcaataattccctcatgtgaagcaacgtgagctaactgcagaccaccgattacgtctccaattgcataaatatgagattccttcgtctggcagctttcattgactgaaatcatgccattttcagtaacaatatcggtgttctctaggccaatgccttcgatatttgcctgtctgccgatggaaactagcattttctcagcagagtaggtaacggtttctccgtctttttccgcttgtatgctgatatcatctgatgtttttgtcattgtgtcaggcagcacttttgcccctgttatgaactggatgccttttttcttaagaagactttccatttcttttgaaatctctagatcttcagtcggcaatatgcgatccgcgtattcaataaccgttaccttcacaccaaaatcatgaagcatagacgcccattcgataccgataacccctccgccgacaatgatgattgattgtggcagctcctccatttggagcgcctcatctgaagtcagtacagacttaccgtccgcttcaagacccggaagcattctcggtcttgatcctgttgcaatgatcacttgtttcgggatcagcatgtcattttcttcgccatttccccgctcaacagaaattgttcccggcagcggagagaagattgacggtccaaggatacgtccatatccggtgtacacgtcaatttttccttttttcattaaatgatttacacccgctgcaagcttatcaacaacggcttgcttacgctgctgcactttttcaaagttgagggacacgccagccgtttccaccccgaattgatcggcttcacgagctgtccggtatacctctgcgcttctaagcagcgctttactcgggatacagcctttatgcagacatgttcctccgagtttttccttttccacaacggctgtttttaagccgagctgagcggctctgatggccgcaacataaccgccggtaccgccgcccagaatgactacgtcatactcagttgccatggtgactcactcctgtctgtctattcaatacgatattgtttggattgctcttcgccctgcaatactctgagcgccccttgggcaagagactgcagttcattttcacccggatagactaaaacgtctgaaatccaatctatgtatgatctgatagcagaaacaaagcttttgccgtacgcaaggcctcccgtcagcacaatcgcttcaacttcgccttttaacgccgcgctggctgccccgatttcctttgctacctgatatgccatggcatcataaatgaagcgggctttttcatcgcccccttgaatcatctgttccacttttactgcatcatttgtaccgagatagcctaaaagtccgccggtgccaacaagctttttcatgatttcttcttttgtatattcccctgaaaaacatagatcaacaagatctcccgcaggcactgttcctgctcgttcaggactgaatggtccctcgccgtgcaggccgttattgacatctaccactcgcccgcggtcatggacgccaattgtaatacctccgcccatatgggtaataatcattttcatgttctcatatcgtttgccaagggaggctgccgctttacgagcgacagctttttgatttaatgcgtgaaaaatgctttttcgttcaatttcaggcatgcctgaaactttcgcaagcactgacatttcgtctacgacaacagggtcgacgatatacgaagggatattcaggccgtctgcgatttcccgcgcgataatgcccccgagattagaagcatgctgaccggcgtaaccgcttttcaaatcctcaatcatttcatcattcactacgtaggtcccgccttcaattggccggagaaggccgcctcttgcgcagactgcatcaaactttgagatattgattccctgttcatgaagcgtttcgagaatatggtttttacgaaattcatactgatcaataattcggtcaaatcgctgcagctcttctatgttgtgtctcaatgttttttcaaaaatgcttctttcgttatgaaaaacaccgattttcgttgaagttgagcctggattaattgtgagaatgcgtttttcgtcatgtagcactttcataacctccagatcaatttcttaacgtctgcttaatacactgtggccgttttgcaaaaactggcttcttgagcggcgcatgcgttcaatccgttcctctgccaagcggtcagccgctaaatatgcaggaatgccgtcacgctgagaaatctctagtacacgctcgatattgccgtaaatgccttcgacttttttcaatgcacgttctgcattatagccgtaaagctcatctgccacgttgatgacaccgcccgcgttaatcacgtaatccggtgcataaacaatgcccatttcgtgaatttgatcaccatggcgtgtctcttttaattggttgttagccgcacctgcgatcactttcgccttcagctgtttaatggtgtggtcgttaatagtcgcaccaagggcacacggcgcataaatatcgcagtcttgtgaataaatgtcatcaggatctaccgcacgggcgccaaaatcttcaactgcacgctgtacagattgtttgttgatatccgtaacgattaagtttgctccttcttcatgcaggtggcggcaaaggttataggctacgttcccaacaccctgtacagcaatggtttttccttcaagagagtcggttccgaaagcagctttagctgctgccttcattcctctgtacaccccgtatgctgtgactggggacggatttccagaagaaccgaaagcaggagaaatccctgtaacgtagtctgtttcatcatgaatgatatccatatcctcgaccgttgtgcccacatcttcagccgtgatgtatctgccgttcagcccttgaatatagcggccaaacgcgcggaacatttcctcatttttgtctttgcgcggatcgccgataatgactgtttttccgccgccaaggtttaagcctgccgccgcgttcttataggtcatgcctctagccaatctgagcgcatcttcaattgccgcttcttcattttcatatgtccacattctcgttccgccaagcgccggaccaagcgttgtatcatgaatggcgataatcgcttttaatccagattgttcatcctggcagaataccaattgttcgtaatcgtatttctccatatatttaaaaagttccatgttcgttcctcctaatgtgtgtattcttcagatgcgcatattgccagcgcaatggaatacagtttattttcagcagagtccgctctgcttgttaaagcaatcggtgctttggctcctgtaatgacagccgccacgctggccttggcaaaataaatcagtgatttatataaaatattgccggcctcaattgttgggacgagaaggatatctgcgttgcccgctacgtctcccgaaatttttttctgagccgcggcaatttgtgaaactgcgttatccaaagcaagcggtccatcaacaatgcagcctttgatctggccccttttgtacatttgagctagagcagctgcattcatggtcgcttccattttagggttcaccgtttcgaccgctgcaagggcagctgcttttggcatattgttccccactgcatgggccacatgaacggcattttgcaaaatctgccggagctcttccagcgaaggagcaatattcattgccgaatctgtcacaaacatcagccggtcaaaatccggtatatcgaatacagccacgtgagaaaggacacttgctgaccgaagcccctcctgtctgttcaataccgctttaagcaaaacagaagtcggcacattgcctttcattaaaacgtccgctgttttatgatgcacagcacgaaccgctaatttcgccgattcctcaggagtatcggcatggacgatttccacttgatgcccttgcatggatgatgtcagctcgttcagttttgtgctgtcgcccgttaacaagaaacgggcagataggtgctcggctgccagctttacagcccggatcacttcctcatcctcagcatgagcaaccgcaatggtcttatttttgtgtatcgacgctttgccgattaaatctttcagcttcatctgttaccacctttcttgtttcgactccgccttttattatgcaagttccatgccagctcttaagggtgctgtcataccaggtatattgaaacattcgtgcagatgtttgcgtttattctgcaaattattgcatgccttcatttgcaaggccatatttatccattttgtaatataagttccgaatgctgacaccgagagcttttgctgtttttgtccggttaaaatgatgcttttcgagcgtttgctggatcaaatgtgcttcaaatttttctactgcgacagacagcttttcgccttcaatatccggaaaatcaaaacctgttccctgatctgtgtcattttctttttgctcaagttcgaatacaggcaagtgatctttttcaatccattccatatgcggattcagaaaaatcatggctcgtccaaggacattttcaagctcccggacattcccaggccaatggtaggcagataaggcgcgcaaggcttgttgtgagagcccttttacattcctgccgtaatcccggttaatcttttggataagtctgacgctcaatgcttcaatgtcctccaaccgctgccgcaaaggcgggatggagatcggatagcgattgatccggtaatacaggtcttcccggaatgttccgtccgccatcgccttttcaatatttacatttgtcgccgcgatcactctgacgttgacagggatcgctttcgtgccgcccactctgacgatttccttttcttgaaggacgcgcagcaatttggcctgcatattttgtgtcagctcaccgatttcatctaagaaaatactgccgttatttgcttcctcaaataaaccctttttaccgccgcgcttcgctcctgaaaacgcaccatcctcatagccgaacaattctgattcgagcaggttttcagaaagggctgcacaattcacgcgaataaatttattgtatttccggtcactttcgttatggatggcatgggcgaacagttcttttcctgttcctgattccccgcgcagcaagatggttgccggtgttttcgcaccgagcttcgcctgctcaagcgcaaccagcatttgctcgcttttgccgataatgtcgtcaaacgtgtatttcgcttcaagcgtgcgaataatttgtctggcgcgattaagctccgctgtcagcattttaatttcggaaacatcgtgaatcacgccgacgctgcctttcaaaatcccgtccacaatcaccggtgctacattaacgatgacctctttttcattcgggccgaccttcattctgacaccgcggacaggacgtcttgtttcaagcacctttaaatgcatgctttcgccttcggaaatatcagtgtttgcaggcttgccgatgacttctttttcagaaagccccgtcattttcgtatacgctttattgattagcaggccgatgccgttttcatcaacgacagaaatcgcctcatcggaggattgaataatcgcctccagcatcgtacggacctgctttaagttggtcacttcctctgccagctcgaccgcatcagtgatatctttaaacacacaaagagccccgagcagacgtccgccttcatcaataatcggcagtcttgtggtcacaatttgcaaatgatcgcctaacagctgcttctggttgtattcaggcactcttgtttttaaaatccgcggcatcttagtgctcggaatcacttcttttattgggcgcccaatgacttcctcacgtttttttccgaccattttttcggccatatggttaaagagaatgatttcttcattgatatcaataaaaatcattccatcatgggtggaattaaaaattctgtcatatttataggtttgctcttttagcatttgaatcaggtgctgcttttcttccatcagctgaaaaacgatgtatgccatttttcccggcatgacaatggtatcttcatgctttctttgaaggagctcgtcaaacacggcttgatcgccggtggcatgaatgacgatatccggtttttgttgtatgtaaggtttccaatcagatgatacggcaatcccatactgttctgcttctttcaatcccggcgcctcggggtctttgtcaactacggcaatgatatctatgatggctgttttaatcagaatatgtaataacgccgttccccttttgccggcacctactatcagtaccttttgcatcccgatacccctttgtatgaaaaaatttgcacacctatttattccgttgcaataatttgcacaaccctatgttaccacgttttcttctcttgacaaaatattttttccgctggacaataaaggaaatgaaaagataaaggggttttctgaagatgagccgacttcttgcgcttttaatattagtcatccccggggctatttctgctttaggcattaaactgatgagagatacacttttcggccatacaatcaagccattttcagctctttggctccaagggttgtcaggattcatcttttttgcgatcggcctctatgtgctggccgggttcattttatacagagacagaaaacgcaatcaagtcagcccgcgattcagaaaacgatagctgcaaaaaagccggaggatgctccggctttttttgttgcactattcgtcaggcaaaacggtcttggcaatcgttttgtctaacgcttcataatcataataagaaatcgtatcgtacagttcttttcgtgtctgcatatcatgaagtccttctttttgtgagccgtgctccttcatcaaaccaaacatccgctcacaagcttttgccgccgctcgaagcgaggtgacaggatatatcaccatgtgaaaccccatatcttcgaattcatcggcacgataatacggcgttttcccaaattcagtcatattcgcaaggagcggaacggagatacgctcagcaaactggcggaattcattctccgcctgtagcgcttccgggaaaattgcgtccgctcccgcctcaatgtaaacctctgaacgttttattgcggcatcaagcccttcctgcgccctggcatcagtacgggcaacaacaataagggagggtgccgcttgtttaatggcttttattttttgcgccatttcctttatcggaactagctgtttgccatttaaatgtccgcatttttttgggagctgctggtcttctatttgaacggctgctaccctggcttcaagcatctcccgggctgttcgggcggcatttaagacaccgccaaatcccgtatcgatatccacaagcaaaggcagatcagctgcacgcacaagatctttggcccgttcagctatctctgccgatgtgatgatccctaaatcaggcagccccctgctggctgtataggcagcaccggacaaataaatagcagaaaaaccggcttctttcgcaagcaaagcggccatcccgtcatgggcgccgggaatttgaagaatgtccggtgctgacatcagcttgcggaaacgcccggcaagctcctcttgtgacgattgcttattgacgatccacgacatgaaacaaaatcccccttttacatgcagaacatgtctacgaattcatttacgcgcatcgtttgtaatgtctcatagctggtacagcgctcataaatgtgtttgtgctgtttaacaggaaaatgggttttgagattgtcagaaaacttttccagcagtttcggcactgcttcctctcttcgaaaacgatggccgaggggaaactcacattccaccatttccgtgctcgttccgtctttaaaatgaacctgaacggcatttgagatggaacgtttatcaggttttaaataatcctcggtatatgttttattttcagtcacttccattttatcacgaagtttatctatcctcggatcactcgctgtttcagcttcataatgctgtgcggtgatatcaccaaaaagcaaaccgattgctgtaatgtattggagacagtgatcacggtctgccggattgtggagcgggccttttttatcaatgattcggatagcggattcatgcgttctgatgacaactcggtcaatctcgtcaatccggttctttacctgcgggtgaagaatgacggcgcactccgccgctgtctgggcgtgaaattccgcaggataagacactttaaataacacattttccatgacataagcgtcaagcggacgggcaagcttgatctctttcttattgaataaaacgtcttggaacccccaacccggtgcactcagggctgtcggataacccatttccccttttaacgacatcagggccaaatgaacacctctgctcgttgcatctcctgccgcccatgatttacgcgagcctgtattcggtgaatggcggtatgtcctcaatgctgcattgtcaatccatgcattcgaaagcgcatttttgatttcttctcttccgccgcccaaaagctttgccgcaacagcggttgtcgcaactttgacaaacagcacatggtcaaggccaactcgatttaagctgttttctaacgccagcacaccttgaatctcgtgtgctttgatcatcatctcaagtacgtcgcgtactgttaacggctcttttccttcagacagcctcactcttgatacataatcagcagcggcaaggattcctcccaagttatcggatggatgcccccactccgccgccagccacgtatcgttgtaatcgagccagcgaatcatgcagccgatattaaacgctgccctcacaggatcgagaacatatgacgttcccggcactttgcttccattcggcacagtcgttcctggaacaatcgggccaagcagctttgtgcattccggatatcgtagcgccaagatcccgcagcccagggtatccagcaatacatgccccgctgttgtatacgcttcggcactagtaatctctttttcaagcacatagtctgtgatttctacgattacacgatccgttttcggcattctaccagctcctttcatgattttgtttgatatcgcgggcccatgtaactgacacggggacggaagagccgattattggcatgctgttcgatcacatgggcgcataaaccggacgttctcgcgctgaaaaagaccggcgtatataaaggaatcggtatgccgagcatccaatacaccggggcagcatagtaatccaaattcgggtaaagccctttttccttctccatcagccgctcacccgcttcacacatctcatataaacgatggtcaccggctttatcgcataattgctgcagcgcctctttcatcatgagtgctcttgggtccatttttttcatatacacccggtggccgaagcccatgattttttcttttcttttcagttttgtttgcagaagctgctcaaaatcagatgtcgtttttgcctccaaaagcaaatacatcacagcttcgtttgctcctccgtgaagattccctttcagggaagcgacagccccagtcaaagccccataaagatctgaatgtgtagatgcaatgaccctggccgcaaaggttgaattcggcatctcatgctcactgtacaggacgagcgaccggtcaaaaatctgttcttccaatgaagacggcaatttccctgtcatcatgtatagaaaattcgcactgtaggataaggtatgaagcggaagaatcggttctttcttattaatgatcctgtagctggcagcagtgagggcaggcattttcccaagaagctgataggcgcgttctttgtttgcggagggagaccgatcatcaatttgccgatcatagccagcaagtgccgacaggccggtacgcagactatccattggatgagtgtcctcagggagcagctcaagcagacggagatgatcagcaggcaggcttgcggcactgtttattttacgttccagcgtctccatttcactttcttctggcagcctgccctccagcaataaatggacaagctccagatagctttttgtttcagaaagttctattaaatcatagcctcttatcaaaatctggctggactgcgtgtcaagataagaaatatgagtttctgccgcaatcacaccgtccaaccctggagaatattgctgtttctcctccatatcctcaacctccgtttatgcgttttttgtccatcaggttccgccaagcaaatacttagaaataatcagtctttgaatctcgttcgtcccttcataaatttgcgtcacctttgcatcgcgaagcaggcgctcaactggataatccttcatatagccatatcccccataaatttgaacggcgtctaacgccgcctttacggctgcatcggaagcaaattgtttagccatagacgcttcttttccacaatttaggccgcggttatgaaggtctgcggcgtggtagacaagatgtcttgccgcctctgccctagtcgccatgtcagccagcttaaatgatatgccttgattggctgcgatcggccttccaaattgcactcgctgcttcgcataatcaacggcatgctcaagagccgcctctgcaattccgagggcctgtgccgcaatgccgatccggccgacatttaaattcgccatggcaatgtgaaagccatccccctctttgccaagcaaattggcttcaggcacttctgcattatcaaaaatcagttccgtagtattggagccataaagccccagctttctttctttttttccaacggtaaaaccgggtgtgtttttttcaacaataaaagccgaaatcccgtgcctgccttgatctggagctgttaaagcaaatgtgatatagatatcagctgctccgccattcgttatgaatattttcgatccgtttaatagatatttgccgttctttttgattgctgttgtgcggaggctcccggcatccgaccccgagtgaggctccgttagtgcaaatgcgcccaaatggtctcctgacgcgagctttggtatatatttcatcttctgttcttcgttgccgaaatacagaatcggattcgtgccgaccgaggtatgaacggagagtatcacgccgacagccgcactgattctagaaatctcatgaatcgccaaaatataagaaacaacgtccgccccggcaccgccgtattgttccggcaccggtattcccatcagtccgtgttcacccatttttttgatcagctgaaatggaaattcgtccgttttctccatgatatccgcagcgggagcaatttcttttcgtgcaaaatctcgcaccatttttcgcatcatgacttgctcttgggttacatgcaactcggccacccccggatggaatagactttaggaagtcctctcctcatagtcataaaaaccgcgtccgctctttttgccaagccagcctgctttgacatacttgcggagcagcgggcaaggacggtatttggaatcgccaaggcctgagtgaaggacttccataattgataaacacgtatccagtccgataaaatccgctaatgcaagcggacccatcggatgattcatgcccagcttcatcacttcgtctattgcctccggcttcgccactccctcatacacgcaataaatggcttcattaatcattggaagaagcacacggttggaaacaaacccaggaaaatcattgacttctaccgctgttttccccatcttttccgctaatgccataacatctaaggccgtttcttctgatgtagccaagccgcgaatcacttcaaccagcttcattacaggtacgggattcataaaatgcatgccaataacccgttgaggccggtttgttacagcagcgatttctgtaataggcaaggaagatgtattgctggccaaaatcgtatgagacgggcacatgcgatcaagtgttttaaacatctcagtttttgccgccatgttttctgcgatagcctcaatcacaatgtccgcatgctctgcctcctcaagcgtttgagaaatcgaaatgcgactgattacgctcttcacttccgtctcggtcctttttcctttctcagcatcacgggccagctgtttcttcagccgtttcaatcctgcctccgcggcctctggattcacatcatacatccgcacataaaagcccgcgtcggcagctgtttgagcaattccgcttcccatctgacctgcgccagctaccatgatttgtttgatttccattcaaatcccctttttcatcatgttttaatgaacctgcactaagacggcgtctccctgtgctgccccgctacaaatagcggcaacgcccagaccccctccccgtcgctttaattcataaacaagcgtcatgagaattctcgcaccgctcgcgccgatcgggtggccgagcgcgatcgcaccgccatttacatttactttttcaagatcgaaacctacgattttttcacatgtcaaaacaactgaagcaaaagcttcatttacttcaaacaagtcaatatcttggacagttaaaccgttctttttcagaagcttgttaatggcaaatcccggtgctgccgccagctcgtgcgctggcattcccgtagttgaaaaaccaagaattgtagccagaggccgtttgccaagctcagcagctttttcctcagacatcagcacgaacgcgccggctccgtcattgactccaggagcattgccggctgtgatagaaccgtcacttgcataaataggagaaagtttcgcgagctgatccagacttgtgtcacggcgaatcgcttcatctttatcaacaacgtttggttttccttttcgaccgatccagttgacgggaacaatttcatcctgaaacttcccttcatcggcagccttagctgcccttgcatgacttctcaacgcccattcgtcctgctctcttcgtgagattgcatattccatggcagctgtatttccgtgaacagccatgtgcacctcgtcaaatgcgcacgttaatccgtcatacaccattaagtccctaagctcgccgtcccccatccgtgctccccagcgcccggcgggaacggcatacggaatattgctcatgctttccattccccccgcaacaagtatgttcgcatcctgcgcccgaatcatttgatcacataaagtgacagcgcgaaggccggaagcacagactttattcagtgtttctgacggcacactccaaggcattcccgccagacgggcagcttgacgggaaggtatctgccctgagccggcctggacaaccatgcccatgacgtttccttctacatcatctccagagactccagcccgttgcagcgcctccttcatcacaatgcccccaagctcagcagctttcacctctttcaaaactccgccgaatttgccaaatggagttcttgcagcacttacaatgactgttttcctcatggtttcacctcattcagatagacagcgcttacaatttctagttgtcttctatgaatgtatgctttgaaacgggcatgaatgaatgaaaaaagaaggctgcgtcaaacagcctccttctaacaactattcatttttcagcaatgccgaagccttttctggaaagtcggtaaacatgccgtctgctcccgcttcaatgagacgcttcatatcttccggacgattgactgtatacggccttaccttaatcgaactgttcctcattttctttagcacttcatctgtgacccttgggctgtttaacttcgggtgatagccggaagccggaatagacgcgatatatcgatctgcctggtaaagcacatctgaagttaatactgcccgttcgatatgcggcgcaagccgggcgcatagcgccaagctgtcatgattaaaggtggataggatgactctctcctctacattgaatcgcttcactgcctccagcactttttcttccattccctcatagcggatcacgctgttttttaattcaatgttgatgagaaaatccttttttaccgcccacgagagcacatcttctagcagcggcacttttatatcgctgtacgcttgatcgtgaccagcggccgcattcgcagtcttcacctcatcataggctgtatccttcacgaatcctttaagtgatgtcgtgcgattaagtctttcatcatgaattacaacaatgcgtccgtctttcgtcagctgtacatcaagctctatcccatccgctccggcttcaattcctttttcaaatgcaagcattgtattttcgggaaattgacctgatgccccccggtgggcaaaaatctttgtcatcgtttcacctcaaaccctaaagttttctccattatacttattttgtcggctccactctaggattaaggctgtatcaatctactgatcataataagaatcaatgccgttgacaatcgcatctgcggccttttgctggtattcttcacttcccagcttgtccgcatcagagctgttcgtgataaacccaagctccgctaacacacttggcatttgtgaatatgtaatgacgtaaaagtctgattctttcacgcccctgtctctcgtttgtaaggatgaaacgagctgtgactgaatatcggatgccagacgccggctgttctccccttcataatcagattgaaaatacgtttctgttcctgaagctgaagcaacccctgaattcacatgaatgctgacaaaaaggtcagcctgattggcacttgccttagccactctttcctccaaggtcagaaaatgatcgtcagaccgggatgcaacaggattggctccctcctcttttagtttgtctgtcacatgctctgagacagccaaattaatatccttttcaaagagcccgtttccgaccgctccactgtcttcaccgccgtgtccggcatcaatatacactgttttcccttctatcggctctgctgcctgtgcacaaggcgcgagcgtcaaagccaatccgcacagcgccaagctcctccataacattctcaacttactccctccggtctttttatgacgagttctttcgcagctgaatatcttccagctgtaaagttccattatccttctttgtatatttcaccaggacatgtgtctgatctggcagtgattcacattcatcacgtttatccttcggaacttgtatcatggtttcttctccattaagagacaccgcaatcgtatgaggatcagccgagccaatgtattttccctcttcggtaaaccttggcactgagtcatccgcacttgcaacactgcaccccgaaagaaagagcgcagtaaacagcaaaagaaccgtttgtttcacatgaccacctcttcctgatgtttggcttttatctttgaccagaatggcgaatttgtaaagacaacgcgaatgcaggcgagcaagttccatgattttcaaaagggctatacgacccgatcatttcctgttgttagaaagataacgagcagatttgtctatgaggatggctctaattgaggcgccaattagaaaaaattagcggaaagaagcaactttttattcattttaaaaaatttgagaatagggtgagcaaatcgtttgacgggtgggtcagccaagcgtaaccttttaaaggatatttactttattgaaagaagttaaagccatgaaaaaattcgttctgctgctggcggcaactgtcatcacatgctccatcggccaccaaatcagcggcggctacaaaggccccgaaaaagagcggcgaaaacatcactctgcactcaagatattcagtcggtaaagcagatcaattgcattaatttttacatataggctagaatatgtgcgaatccaaacgaaagaagatgatcaaatgaatcctaagtataagcctctgtttgaaccatttacgtttaaaagcggcgttacaatcgacaaccggatcgcagtagcaccgatgactcattacgcttctaatgaagacggtacaatatctgaagcggagctcgactacatcatcccccgttcaaaagagatgggaatggtgattacagcctgcgcaaatgttacaccggacggaaaagcattccccgggcagccggccatccatgacgattccaacattccaggtttaaaaaagttagcacaagccattcaggcacaaggcgctaaagctgttgtacaaattcatcacggcggtattgagtgcccgtctgagcttgttcctcaacaagatgttgtggggccaagtgacgtgtttgataacggcaaacaaattgctcgcgcattaaaagaagaagaagtggaaaacattgtgaaggcgtttggagaagcgacaagacgtgccattgaagcgggctttgacggtgtcgaaattcacggtgcaaacggctacttaattcagcagttttattctccgaaaaccaaccagcgcacggatcgctggggaggaagcgatgaaaaacgattagccttcccgctcgctattgtcgatgaagtgaaaaaagccgcttcagaacatgcgaagggtgcgttcttagtcggctaccgtctgtctccggaagaacctgagacaccgggattgacaatgactgaaacttatacgcttgttgatgctttaggggataaagaattggactatcttcatatctcactgatggacgtgaactcaaaagcgcgccgcggtgcagatccgactcgcacacgcatggacttattgaatgaacgtgtcggaaacaaagtgccgctgatcgccgtcggttccatccattccgctgatgacgcgcttgccgtcatcgaaaacggtattccgctagtcgctatgggacgcgaaattctagttgaccctgactggacggtaaaagtaaaagaaggccgtgaaaagcaaatcgaaacagtgatcaaaggcacagataaagaaaaatatcatttgcctgaaccgctttggaaagcaattgtgaacacgccaggctgggtgccttataaagattaatgtgcaaaagactgccgaaacgattcggcagtctttttccctttatataaatagtttgtgtacacatctaaacagcaaaagaaagagctccccaccaacttcgaaaagaaaatccaggaaaaacccctcttgcttttttctttttcattcgtacgtctcctttttacatgaatacgccttacttacgattttgcaggagaaaggtttcattttataacggacacatttagggtcgatcatgcttcgtgatcctataagatgtatgaatggaccaagagtgcaggtaataccgccatttgctttccttacttttcaaacctatcctttactatatgcggatacttaatattcttctcccatactacaaatgtccccaaaacaaaacgcctcctatttatcagcgcaaactaataaataaaagacgtttgatttaatgaccacttaataagctcatgtttaagaagccttatgttctaatctcagcttatccgcaaccattgcaatgaattccgaatttgtcggtttagcttttgtcatgctgacagtataaccgaacaacgaggaaatggaatcaatgtttcctctgctccatgccacttcaattgcatggcggatcgctctttctacacggcttgcggttgtgttaaattttttggcgatgtccggatagaggacttttgtaatgctgccaagcaattcgatgtcattgtataccattgagattgcttcgcgcagatagagatagcctttaatatgggctgggacgccgatttcatggataatgcttgtgatgctcgcgtcgagatttttcttctttggttcaggctggctgctgcgtataatactgctttgcgatgatggcgcacgatgcgtcacactgctggcatttccgctgacctggcggatatggccgacaaggttttccatatcaaacggtttgagaataaagtaggacgcgcctaaatcgacggcctttttcgtgacatcttcctgtccaaaggctgtcagcataatgacattcggctgttttttcagatctgattccctcagcctctctaaaaccgcaagtccgtctaaatgcggcataataatatctaatacgagcacatcgggatctttttctttaaacagcgacaggcattcctgtccgttataagcaacgccgatcacttccatgtcttcctgtccttctatatattcacttaacaggcttaccagctctcgattatcatcagcaacacaaactttaattttctccacgtttcttcctccccaaatgtagttaacaggattcacccttgctacatgtttacattcgacaaaaccgctatataccctctaaaaaaatcataatcaccaatattagtggcatatctttgttattctatgtttttctctgtttttcgactaaaaatgaaatttgacaaacaaggaaacgtgaatttgtcgaaaaatcttcttttgtatattttaccgtatgtattctgagaagtgaagagggatcaaaataaaaaaactgccggaaactccggcagtcagcttgctttttcttttccataaatatcgattcctgcttctgacagcatccattcaatatgaacaccgtagccgcttgtcgggtcatttacaaatacatgggtgacagcaccgatcacttttccattttgaataatcgggcttccgctcatcccctgtacgatgcctcctgtttctttcaacagccttggatcggtaattttcaacaccattccttttgtcgcagggaatttttgcggcgttgtgctgacgatttcaatatcgaatttttctactttgtcatcatcaataacggttaaaatttcagccggcccttttttgacttcggtagaaaacgcaaccggcaatgcttgatctgatatgttgttttgaatcggctgatgcagtgtgccgaaaatcccaaacgggctgtttttgttaatatccccgatcgttttgcgttctgaggaaaatcgcgccagtttttctcccggattaccgcctgtccctttttcaattgatgttacagtggatttaacgatttctccattctccactacaattggtttctttgtgtccatatcggaaatcacgtggccaagtgctccgtatttttttgttttcggttcataaaaggtcatagtgccgatgccggcagcagaatctctgatatataacccgattctgtatttgccttctccttcatccttttctgggatcagcttcgttttgattttctgtttatcacgtttgatcagtaagtctaaagattcaccagttttcccagccttttgaataaatggggctacatcattcattttttcaattttctgtccattcatctcaataatgatgtcgcccgcttcaattcctgccgtttctcccggagattttttgccttcacttgtattgatttgatgaaatccgacgacaagaacaccgacggaatgaagttttacaccgattgattgtccgccaggtataacttttaaatcaggaagaacatgcacttttgtttttttaattggaaatccggcaagatcatataccaattctgactcacctgattttttgcccgtcaccttgatttcatgcggatctttctttactgtaaacgcttctgaggattctgatgtctgagcgtttaccgataaactcgtttcaatcgcttgtgtttgggtttcaaatactctcatttgcgttggaatcagtaaatattcttttagcggtttgcataaacctacacttaataacgaaacaaggagaattaaacctactgcttttctgatgttatcgggcattcactacttcactctcctcgctcctatcccacaccttctttatgacttgctgctacatcatttaattttgccttctgacggcttatttataactgtcatatgaagaaaaacattggatatactgatgaacgaatggatgtgcacgaaaaaaataagctgcgcttctcgcgcagcttacccagttgttttgacttgatccgcttgttttaaaagttctttcgcatggcgtttcgttaagtcggttacttcgacacctgcaatcatgcgcccgatttccgctaccttttcctgcttagagagcggcttgacacgtgtcgtcgttctgccgtcttttaactccttcgcaatataaagatgcgtatcggccatggcagccacctgaggcaggtgtgtaatgcacagcacttgtgatcctattgacaccttatggatcttctcagcaattgcctgtgcgaccctgccgcttacaccggtatcaacctcgtcaaaaatgatcgatgtcacatcctgttgtgaggagaaaatgctttttatggcaagcatcacccgtgacagctctccacctgaagcgactttcgaaagggatttcagcggctcgcctgtattggttgaaattaaaaacttcaccaggtcaatcccttgttcagtcagctgaacgggctggccgtttacaagcggcgcctcttcattgcgtgacgctgttctgaccttaaattccgtatcaaaagttgatttttccatgtacaggctttttaattcccgatgaatctcatcagccagctttttcgcccatgtttttcggatttgtgacacatttgccgcttccactgcgacatctttgccgacggagtcaagctcctttttcaagctttgaaggtggctgtccctgttttcaatttggtcaatctcttcttcaattttagaagcatattccaaaatgtcttcaacagtggcaccgtattttcgtttcagctgtttgatttcattaagtcgcgtctcaatatagttcaggcgttccggatcaaattcaagctcatccagcatatttctcatctgaaatgtggcatcctcaagcaaatagtaggagttcgaaacactttcagacatttttttcagcggttcgtttatatcagatatatcttcaagctgcgctgatgccattccaacccagtccaatccgccctgctcactgcgaagcgcgttatatgcattttgcagcgactcatatatcttctcaaagtttgaaatttgctggcgctcttcttggagctgttcatcttcgttaagctcaagctttgccgattcgatttcttcgagctgaaattgaataagatcaagacgatgggccatttcctgttcgctttcagaaagctgcttaagctttttgagcagcttcacataccgctggtacccttcctgatacgttttgagcgcgctttccacttcggccccggcaaacttgtccaaaagctggagatgattttcgtcttccattaacagctggttatcgtgctgcccgtgaatatctaataaaagcctgccgatctctcttagtgaagcaatcgtgacaagcttgccattgacacggcaaacgcttttcccgctcgtgctgatatcccttctcatgacgatcatttcgtctgaaacgtcgattccctgctcagcgcatacgcctaaaacaggatggccgctctccaacagaaacagcccttcaagttcggcttttgcttccccatatctaacaaattcagatgatccgcggcctccgactaaaagagaaatggcatctatgatgatggatttgccggctccggtttctcctgttaaaaccgtaagcccgcgttcaaaagaaaccgtcagttcctcaataatggcaaagtttttaatcgatagttcagctaacaaacagcattacacctcttatctttgttagattttctgttacagcagttcaaggagcctgttttttacgccttctgtatcttcaggagtccggcaaataattaaaatcgtatcatctccgcaaatggtccccatcatttcatcccagtccaaattgtccatcagcgccccgattgcctgggcattgcccggcatcgttttcagcacaatcatatggcttgctgagtctattttcacaaatgcgtccatcaatgcccgctttagctttgacagcggattgaaacgctggtccgccggaagactgtatttgtaagaaccattatttgtaggcacttttacaaggtgaagttctttaatatcccgtgataccgtggcctgcgttactttgtatccatcctgctttagcatgtcgaccaattcatcctgcgtttcgatttcattgcttgtaatgatctctctgattttaatatgcctctggcctttgttcatgtaagcacctctatttccaagcttatctgttcttttatgttatatgattctctgcacattgtacatgaatgcagaaaaaaggaataatagcgccctattattccggtacatctgcttttttttcttttaacgtcttatgtgcttcttctacaacgcgcatgatctcttcttccggcagttcctggccttcctgtccctctcccggccaatgcaaatgaaggagaaactcaatatttccgtctcctcccgtgattggagaaaatgacaagcctttacagatatagccttcagcggcagaaaaactgatcattcgcttgagcacatcagcatgcactttaggatctctaacaatcccttttttgccgacggattcccgtcccgcttcaaactgaggcttaactaaagccatgcagtcgctgcccggtacgagcaaagtccttaggacaggcaggatgagccgcagtgaaataaaggacacatcaattgtggcaaactccggcatgccctttgtaaagtctgccggtgttgcataacgaaagttcgtccgttccatcacgacgacccgttcatcctgtctaagcttccatgcaagctgattatagcctacatccacagcgtatgactgtttagctccattttgcaaagcgcagtccgtaaaaccgccggtggaggagccaatatcaatcataattttatctttgacagagacgggaaattccttcaacgctttttcgagctttaagccgcccctgctcacatacctcagcgggtttcctttgacagttaacggaaggtcgcggtcaattttttctccaggcttgtccaagcggttttcgtttgaatagacgatccccgccataatggctcttttggctttttcacgcgtttccgccagccctctttccactaataatacatctaatcgttctttctttgacgtcatgatccaattcctttgtgtgtctttggcggcatcagtaatctaatacgatttgccacctgctgttttgtcagtccaatttcctcaagaagcgctgttacacttccgtgttcaataaaccgatcaggtatacccattctgtcaatcggagtatgatattcaccttgatcatgagcgaattctaaaatcgagcttccgaaaccgccttctaagaccgcttcttcaattgttaaaattggcaagccttcttttaggatactcttcatcatcttttcatcaatcggcttaataaaacgcgcattcacaacgcgcacggaaaggccttctttctgcagctcttcggctgcttcaatcgccatttcgattgttgtgccgaatgttaagatgacagcatcgttccctggacgcagcacctcccacgtaccgatcggaatcgttttcaactgttcatccatttttacgccgagtccgtttccgcgcggaaaacgcattgctatcgggccttcgtcatagctaagtgctgtatgaaccatgtgctggccttcattttcgtctttcggcatcattaagaccatgtttggaatgtggcgcataaacgcaatatcaaacacgccttgatgtgtctctccatcagcgccaacgagtcctgcacggtcaattccaataaacacattagcgttttggcggcagatgtcatgaacaacttggtcatatgccctttgcaggaaggttgagtaaatcgccaaaaacggcttcataccctgcattgccatagctgcagccattgttgcggcatgctgttctgcgattcctacgtcgaacatccggtcagggaattcctttgcgaagccttcaagctttgaaccgacaggcatagccggcgtaatggctacaatgcgtccgtcctcgcgcgccattcgctgcacagttccgctgacaagaccgctccacgaaggagctgcggctttcggctttacaaagtcaccggtattaattttatatggtccggtaccatgccatgtcccaatcgtatcggtctcagccggtttgtaccccttcccttttttcgtaatgacgtgcagaagaacagggcctttcgtttttttggcgtattgaagattctcaatcagctcatgataagaatgtccgtccactgggcccaaatacgtaaaaccgagctcctcgaaaaacattccggagacgagcatgtatttcaggctgtctttgacccgttccgccgtggcggcaagcttgcccccaactgccggaatctttttaaataagtattcaagctcatctttgacccactggtatttccccgcagtgcggagccgtccgagcatagagtgaatggcaccgacgtttggcgcaatactcatttcattatcattaaggatgacaatcatgtcttttttctcgtcgccgatgtggttaagggcttcgagcgccataccgccggtcagcgcgccgtcaccaatgatcggaataatatattcatccgttcctttaatatcacgggcagctgccattcccatcgcgcctgacagagaagtcgagctgtgcccggtttcccaaacatcgtgctcgctttcactccgctttggaaatccgcaaagccctttgtactggcgaagcgtcgcaaattcttttccgcgtcctgtcagcagcttatggacatacgactgatggcctacatcccataaaaatttgtctttcgggctgttaaattccttatgcagggcaacagtaagctctacgacacctaagtttgggccgatgtggccgccggaagcggataaacttgtaattaaaaactgacggatttcatcacttaatttctctaattcatcaatggacatgttttttaaaaacgacgggtcctgtattgataaaagatccaaagcggatcaactcactttcagcatgaatttctgcaatgatacatgtcttttgcatgccgagctgacaataatctcagacataaaaaaagacaaacgcgcttttccttttcatttttcatataaactgcttacattttaccatacctcgtgcagccgcttcaaattaggatcgttttagtgatctcttgccgcaattaaatcacaaagctcatataaaaggtctttttgaagagagagtccgccgatcaatcgcttcgcctcttttatatgaacatccaatttatgtttggccccttccaatgaaagaagcgacgggtatgtcgatttgtcatttgtggtatccgagccgacacgtttgccgattttctcttcactgccttctaaatctaaaatatcgtctctgatttgaaatccgattccaatgtggctgctgaaggtacgcagtgtttcaatgtcttcctcaggcgcatcagccaaaatagcaccggcgattacacaaaagccaaggagcttggcagttttccgttcatgaatggattcgagctcttcaagcgtgacttgtcggttttccgcttccatatcagctacttgcccaccgaccatgccttcggtgcctgccgctgaaatcagttcattcacaagccgcaggcgcttttctgctgacacctcgtctgacacgtgggaggtaatcagcttaaagctttctgtgagcagcccgtcacccgctaatactgccgtcgcttcaccaaacactttatggtttgtcggcttcccgcggcgcaaatcgtcatcatccatgcatggaagatcatcatgaattaacgaatacgtgtgaatcatttcgacagcacagcccaccggaatgccgtctttttcgctttttccatatgcatttaaaacagccagtacaatcagaggccgcaaccgctttccgccggcctgtagagaatatagcatagatttctttaatgagtccggcatatcaagcttttctgtatagacagaaagctgattttcaattgtttttttccggtccgccagaaagctcgttaatttatttgtcaccttcgtcttcctcctgaacactgaaaggtgccagttcgccgtcttcttttaaaatgaagtccatttgcttttcgactttttgcagcttttcatggcacatttttgacagagccatgccttcttggaaatagttaatggcttgctctagaggcacatctccctcttcaagctttgatacaatgctctcaagccctttcatcgcttcttcaaatgtcatgttttcattttttttcacgtctgtcatttttcttcccctctcttttctaatacttcacaggtcagcacgccatccttcagcttgacttcaagccggtcctgctcttctatttgactgacacttttaatgagtttatcttctttataagccaagctgtatcctctttccatcacttgaagaggacttagtgcattcagcttgccaagaacggtttgaaattgggaatgcagctgcttcatttggatattcatattttttctcagctgatttgtttgttcctggtatcgtgttctcgcttgtttcagctgttcatgaggatgcagtgcctctaatctgtacgtttcacgctccagctgtctgcttttccgatctaaaagagcggtcagctgtgcttgaaactgctggtacgcgaggtcaaactgctgctctttttgcgcatacaaacgctttggaaaacgaaaggcataggacgattgcagcgtttgaatccgttcttttttctggccgaggtgctgctgcattgctcttgtcattctgacttccgctgtttttgcccgttcgattaaatcagtggtatgaggcacagcaatctcagctgctcctgtcggcgtcgcggctctgatatcggcgacaaaatcactgatcgtaaaatccgtctcatgtccgactgccgatataatcggaatattggaagcaaagatggcgcgtgctacaatttcttcattgaatgcccacagttcttctatcgaaccgccgcctctcccgacaattaatacgtcgcaaatctctttttcatttgcctcttcaatgcgcgtaacgatggatctgctcgcattttcaccttgtacgagcgctggaagaacaatgacttttacaaggggatatcttctttttagagttgtaataacgtctctgacagcggcacccgttggagatgtcacaaccccgattgtggctggaaatgcggggatttgttttttgtagcggtcgtcaaataaaccttctccggcaagcttcttttttaattcttcgtacgctaaataaagcgctccaaccccgtcaggctgcatttctttggcatataattgatagtttccgctcggttcatatacggaaattccgcctctgaccagcactttcattccgttttcaggtttaaaaggcagacgctcgctttgtctcgcgaacatcaccgactgcattcttgcgttttcgtcttttaaagtgaaataaatatgccctcgtgtgtgtatctttacattcgacaattcgcctttaatccaaatattttcaaggtgaggatctacatcgaattttcgttttatatactttgtcagcgctgagacggtcacatacgctgcttcacccatgtctaaaaactcctctcctaagcattcctgcaccataactaaagaaaacccgccctggctttaggagcctgaagaagcgggtatcgtgctcatattcaaggcgggtaaacatttcgcctgtgaatatctccaattatctatgataacgtacgtttcgcagatttaacagtattatgcgcaagcatcgtgatggtcatcggacctactccgcccggaaccggcgtgatgaaggacgctttttcctttgccccttcaaattcaacgtctccgcaaagctttccgttttccagacggttaacgccgacgtcaatgacaacagcgccctctttgatctggtctgcactgatgaagttggctctgccgactgccaccaccaggatgtccgcttttttcgtatgttcagtaatattttctgttcttgaatgacagtaagtaaccgtcgcgttttcatttaataaaagctggccgacaggtttgccgacaatgttgcttcggccgactacaacaacctctttaccggaaaggtcaatattgattttcttcaaaagctcaacaattccatgaggcgtgcaaggaagaaacgtatcttcgccaagcagcattttccctacgtttaacggatgaaaaccgtctacatctttatcaggggagatacgttcgatcaccgctttttcagaaatatggtctgggagcggaagctgaacgagaatgccatgaaactcagggtcttggttatattgatcaataatggaaagcagttcagcttctgtgaggctgctgtcaaattgatcgagcttgaaattcattcccattgtttctgccgcttttttctttcctcgcacgtaagagtgagaagcaggatcatctccaatcaaaataaccgccagtccgggagtgacgccttgctttttaagctcttctacctcttttgccaattgttcgcgtttttctctagccgtttcttttccgtcgatgattgttgcagtcattttctttcctcctatgattgttcaatatcagatttaatgttagaaagaaccccgtttacaaactttgtcgctttgtcatcaccaaaccgttttgccagctcaatcgcttcgttcatggagacattcaccggaatgtcttcggcatatgccatttcatatgctgccaggcgcaaaatcgcacggtcaacattggcaatccgatcgagcttccaattcaccagatgcttggagatcatttcatccagctggtcttggtgttccaataccccgtgtacaagctgttcaaagaaaggatctgttttttcttcatccagtgcgtgttctatggcttcattcactgcaatatcgctgacatcaatttgaaatagtgcctgcaaagctttttctcttgctgttcttcttttcattttctttctcctttgatcctctttatccgcttgtcgttaagccacaaagagatcataacatatttttttcgtatccgcatattgaaatcaaggttttttaccctattaccgaatattttcacacaccttaatatgattattcggatttcacgttcatgaagaaactcggctatgtaagccggctttcttcatgctttgaaataaagggtaacgtgtaaaaaaaccaaagggccgccctccccttggtttcgtgttaagccatttacatttcttcgtcgatttggacttcttgggcttttgtgtcaaattgaatgccgacgatgtgaatattgatctcgttaatcgaaagagacgtcatatttaataaggtttgacgaatgttttcctgaacggatgctgcaactttcggaatcgaaacgccaaatgtaacgacacagtatacatcgatcgtaattccgtcttccgccaggtcgactttgacacctttgccatgattcactttgccaaagcgctcaacgacgcctgtcgcaaagtttccgcgcatttcggcaaccccatcaacttctgatgctgcaatgccggcaatgacctcaatgacctccggtgcaatctcaaccttacccaaatgcgtatcttcgtgatccattttaagcaagctgttgtctttcattcaattcacctccgtaaaaattatgagcccattacatcatatgtttctaaaaatttcgtattaaactctccgctcacaaatgtttcgtgttcaagcagttttaaatggaaagggattgttgtctcaatgccttcgatgacgaattcgctcaatgcgcgcttcatgcgggcaatcgcttcatccctcgtttttccgtatgtgatgacctttgcaatcatgctgtcatagtacggtgggatggaatagccagggtacgcagctgaatcgacacggacaccaagaccgccaggaggcaggtacattttaatttcaccaggtgacggcatgaaatttttacttgggttttctgcgttgattcggcattcgatggcccagccttcaaattcaacatcctcttgcttgaggctcagttccattcctgatgccactttgatttgttccttgatcaggtcagttcccgtcaccatttctgtgactgggtgctctacctgaattctcgtgttcatttccatgaagtaatagcgctgttcattgtagtcatagataaattcaactgttccagcacctgtatagccaaccgcttttgcagcctttaccgctgcatctcccatttgctccctgatttctgaatcaagggcaggagatggtgattcttccaaaagcttttgcaggcgtctttggatcgagcagtcgcgttcgcccaaatggatcgtatttccgtagttatcagcaagcacttggatctcaacgtggcgaaaatcttctatgtatttttcgatgtatacacctggatttccgaatgcagttgccgcttcctgctgtgtaatcttaatgccattaatcagttcctcttcagtgcgagcaaccctaattccttttccgcctccgcctgcggtggcttttataattacaggatacccaatttcattagcaagcgaaaccgcttcttccacattttctataattccctgtgaacccggtacgattggcacgccggcctgtttcatcgtttcccgcgcaacgtcttttgttcccatttttgaaatggcgtcagcgctcgggccgacaaacgtgacattcacttcttcacataattcagcgaaatcagcattttcagctaaaaatccgtatcccggatgaatggcgtccgtgccagtcagctttgcaacactcacaatatttgtaacgtttaaatagctgtcttttgatgctttcggtccgatacaaaaagcttcatcggccatttgaacatgaagggcatctttatcagcttctgaataaacagcgacagtctcaattccgagctctctgcaggctctgatgattctgacagcaatttctcctctgttggcgatcaatagctttttaatcatgttcagtctccttactccgcttttacaagaaatagaggttgtccgtattcgaccagctggccgttttctactaatacttcaacgatttcgcctttcacttctgcttcgatttcgttgaaaagcttcatcgcttctacaatgcagacaactgtgttttcatttacttttgaaccggctgttacatacgggccagcttccggtgatgaagaagcataaaatgttcctaccattggtgaagtgattttatgcagattctcatcttgctttggtgcttcttgggcaggtgccgctgcttgctgcgcttgcggctgaactgcctgcggagcctgtgcttgtacaggtgctgccggtgcctgctgcatgacttgaaccgtgcctgcttcgtgttttttcagttttaaggatacaccttcattttcatatacgaattcgtcaattgtagactcgtcaattgctttaatcagctcgtggatttctttgatatttaacattcaatcgcactcctatgtatgaaatttcttttttataggttactactaaaagtacatactatgttcatcttacaggagcggacttttgaattcaactctaatatgacagcaatgcaaaaagcccgcttgtttagcgggcttctttttcctctttcttacttggatggttcaaatgtgacagcgacatctttcattgttttgatttcttttgccacaaggtctataatggctgtcgccttcgatttggagtgtttgtctgatttgactgtaatattgattttatctccttcagcattaacgagcgcatcctcgtaaccttgtgttttaatcagcgtttcaagctgtttttctgttccttccacttcactgagagccgtcattttatcgtatgcttcgcttttctccttggctgttgcatcatcgcttgacacaatggcattcagctcttctctttctttgcttctggcatcttctaaatcaagacggtacgttgtaaacagatcatcatcggctgtttccgtaacaacagttcctttttcactggcttcagcggatgtttccttgtctgctgatgaatctttcgttccctttgttccatcttcttttcctttttcagtttctgtaccgcttttttccttcgtgtcttgcttggcaggcgctttttcagttgcgacctctccgctgtcagacgcgcttttttcactttgcatctgcacggcgtttttgctttccggcgacatgatatagtagacgcttaacaccacgacaagactgagcattgttaatagccaaacggtttgttttttaagcatttatgaatcctcctttatttttttaggggcaaccgcaacccggtggcttggaacatccaggacccgtgtcaccgcttcgataatggtttgttttatttgaacgttgtccactccttgagcaacaacgagtacaccgcgtatatcaggttttttcgtttggacgacgacaggtgtttctttatcgccgtttttgatcatgacgatttcttcctccgatgtttggtctgtaacgcttcttttcccgccttccttgtcagtttcttcagtggttgtatttttgtttgatttgtttttttcgtatactttcagcgacgttgcatctacattcacgacaaccgagacatcgtccacaccaatgattgtttcaagaatttctttcagctgattttcgtattctttttcatagtcatcgatcgagtctttaggtttatcagattttgaggctttaaacacttcagctgttttctctttgctgtctgcggaatgttgcgatgatacggccgttatcgttttggcgttttctgttttctcaggtgaagaaaacagctggctgacaagcataaaggaaactccgagaacaaaaacgaatagaaagtaatgatatttggtcagcttcggcttttcgccgtcctttgtttgtcccggaagaaactgctttttcaatacattccataatccgtttttattcattgccgacactctccccgccttccatatgaaccgtaattttctcacttccgatttcccaaatgtccgcgagctgcgtttttatctgtttggcttctttttgttcggctgcttctttcgttacgtatgcatgatctgtatcaatgtggaccggcgcgaccgtttggaccgttttttcagaagacggggccatatacacgctgattgttttaatatcctcttctgaatctaccttttctcctgccgtgagtttgatgcggcctactttatattcatcatgactgaatctctcctccgctttcttttttagttggacagccatttcttctagaatatatgcgcgctgggaagcttgtatttctattttttttgaattgatttgattttttatgtcggcagactctgactgcccgttttttgtgagatattcaaagatgacttcggggtctgtcttgaaaagtttaaaaatcggcgtaagcatgacgacaatcaagagcaggctgactaccatttttgcgtacttttgcatgctggagctcggcagcagcatatcaatcacaattgcaaataggataaacaacacgatggtggtaagccattccgttaaaaaactcattcgcctgcctccttcatttcatcatcatcgtgaggtttccggctgtgattatgacagtaaggcttaaaaaaaacatgagagacacaatggcgagagctgcaaaaatataaatgacgcttttgctgatgacgtcgaggcaggtgatgacgggcccgcctcctagcggctgaagaatcgcggctgccagcttataaataaaagcgagggaaagcactttgattgccggaaatgccgcgatacagatcaaaatagcgacaccgagaatccctaccgtatttttcagcagtaaagaggcgctgattactgtatctgttgcgtctgtaaacattcggccaagcacaggaataaaatttccggttataaatttagccgtcctgagcgtaatgccgtctgtcactgcagctgaggctccctgaacagagatgacgccgagaaagatggtaagaaaaacagccagtgctccgatggcgatatttctgagcaggttagccagctgcgttactttgtattgttcagtcatcgtgctgacaatgctcagaatcgctgataaaaaaatcagcggcatgacgatattctgaatcaagagaccgctcgtgttcatcaggaagaggataacaggatgaaagaaggcagcagatacagctccgcctgaggaagccaaaagcgccaagaggagcggaatgagcgccaggataaagctggtcatcgtctgaatcgcctcagttgcatagttaattgccacatgaaagctattaagcgcaaggataatcagcaccatgtacacaattgagtaagcgaccttactgacggtgctttgctgaaaagcattttgcaaaagctgcagaatgacgcaaaaaatcgtgagcaaaatcaatgtgcccagcagctttccgttggcaagcacttcatgaaacaagtaagaaaagagagctttcagccattcttgcggtgagaatgatttatcaccattgataaactccattaagctgcctttttggctttccggcagcagtccgccgtattctgtcataatgtcattccaaaattccccgatcttatctgtttcaagcgaggctgctgtcctttccgctaattgctcggctgtttcagcatggtcttccgtttgttctgcattaccagctgcttgtacaatttctgcacggcctgctatgatcagcacggccaaaagcaaaacccattgaaagcgcttcaatctaccgcctcctttcggttatgacatagaaggtataagtccgagaatcgtttcgataatgacggttaaaataggcacagccattacgagtattaaaattttccccgccaattctattttcgaggcgatggctccttgaccggcatcttttgtgagctgtgccccgaattcagcaatataggcgattccgataatctttaaaatggtttcaacatagaccatgttgacatttgcattaatcgcaattttttctatcattcgaataatgtcgtaaatttggtctaccaaataaagaaaaatggcacatccggcaaaaacgacgattaaaaacgcaaaagtcggcttttgttcttttacaattaaagaaaggaaggtggcgatcagccctaaacctacaatttgaacaatgtcaatctgcaagcccccctatccttggaataaaaacacagcttttatctttttaaataggtcatctacaatcgtggcgaccataaataaaatatagataaaacctaacagcgtcacccactgagcgtattctttcttgcccatctgatccaatatcgtgtgtaaaaaagcgaccacgattcccactccggcaatttgaaatatgacattcacgtctactcccattttatttttgctcccctcacgtttacatcaatagaagaatgagtaacaagcccgctaaaaagcccaaactttttatcattttttcatttttcgcttgcgcctgctcagcatccgcttcagaggcttccaaatgtgtcagcgccagcttgatgtgcttttgctgagagattcgatcatgaatcccgagcgtctcgccaaactgcttcagcacttcgtattcgctttttttcaaagacagggtgtcccataccttctttaagctttgctcccacgccgttttcgcggaatcacttcccttgtccagctgatcactgaatgcggaaaaaagagctgaaacaggctgtgcgagctgtttggcaatctgctgtgaagcagtatgaagcggtgtatggccgtacatgatttcagcctcgagggattgaagcgccgcacgcagctggcggatttgccgcggccgttctgtataaatcttcgccatctcaaaacctgtccatgttgtcgctaccacaataaatacagcgcccagcagcttcagcatgttttcacgcccgtcgtcctagacagcacatttccgtctttgtcataaatttggctcactgtgcccggcccttttgctcttgataattccaaatagcggtcaaaggctctttcttcccacaaacgcttcaatgaaggccgcttcatcaggtcggatatgctccagccatgcgccgatacaattactgaaacaccggcatgcagtgcctccagaagtgcatctgtatcttccatacgcccgatttcatcgacaatcatcacctcagggctcatggatcgaatcatcatcatcagcccttcagcttttggacaggcgtctaacacgtcaattctctgaccaaattgatgttgcggaatgccgcgaagacatccggcaatttctgaccgttcatcgacgattcctgtctttacgggcagcatgggttttttgccggtgcttgagagcctcgcaaggtcccggagaagtgttgttttgccggtttggggcggtccgataatcagcgtattcagccagctgtcttgatataagtatggaagcagcggctccgcaatccccagcttttgccgggcaattcgtatattaaaagatgcgatgtcacggaggcctttcacacctccgttttccgtaatgactctgcccgccagtccgactctgtggccgcctctgatcgtgacataccctttcttcagctcttcttcaagagtatacatactatagttgctaagccggctcaggatcagatgggcatcctcggccgtgcccgcataggacaaataaacaggttgtcctcttcgaatcaattcaacagggcggttgatccgaattctgacttcttcgatttccagccattgttgttccggtatttcagaaagggcgtttttcatggattcggggagaacctcagcgatttcattcaacagagcctcctcctttctaccgattggcttctttaaaatgtatgatgtgaggcagactttatgacaagcctctctttatttatgaacacccgccaaaatcaaaacaacacccgtaaaaatcagaatcagctttgcatacgaaagctgcccggcaatttggtagattccgacagtcatcgtaatgataaaaatcaacggaccgacaatagcgagaatgctgttaaccacaaccgccttccggacatcgttggtcacaagcatgacaattgctgccgtcagctcaatcatagaggataaaactcgtaatcccgccattgttaaaacagtagaattgatatttccaagtaaaaatttcatagcactctcccaacctcccatttttttatatgatatgctctagcttgctgaagtagtcttgtcattttcgtataaaagaaagattctgtttttgggcacaaaaaaagcctgctcccatttgggaacagacttctttttttctttctatgctcttgaaacgtaagaaccgtctgatgtattgacaacaagtgtgtcgccttcattcacaaagaacggcacgtttacaacaagcccggtttcagttttcgcaggttttgtaccgcctgacgctgtatcacctttaataccaggttcagtttcaacaactttcagctcaactgtgtttggaagttcgataccaagtgtttcatcttggtacatcatgatatgcacagacatgttttctagcaggtattttaattcttcttcgatttgagttgcgctcagttcaagctgctcataagaagaagtatccataaatacgtgctgatctccgtttgcatatagatattgcattgttttggtttcgatttgcgctttcgctactttttcaccagcgcggaatgttttttcctgaatcgcgccagtgcgaaggttgcggagtttagagcggacaaatgccgcaccttttccaggttttacgtgctggaagtcaacgacgcgccaaatgccgccatctacttcaattgttaatcctgtacggaaatcgttaactgaaatcatgtttaatgtcctcctatattccaatcacaaaataataagttcttttggggaatgggtgattgtccggttgccgttttctgtaatcacgatgtcatcttcaatgcggacaccgcctgtttctggtatgtaaatgcccggctccactgtgaccaccatacccggttcaaggatagctgaagatctgacggataatcccggcgattcatgaacttccatgccgagcccgtgcccggttgaatggccgaaatagtcaccgtagccttttgcagcaatatgatcccttgtgagggcgtcagcctcttttcctgtcattcccggcttaatatgtgcgacgccaagcgcctgagcatcaaatacaacctgatagatctccttcaattgatcactgggctgacctacagcgaccgtccgggtaatatcagaacaatatcctttataataagcgccaaaatcaagcgtaacaaggtctccgctttcaatcagtttgtcactggccacaccgtgcggaaggcttgaacgaaggcctgaggcgacaatcatatcaaaagaagagctgtctgctccctggcttctcatataaaactccagctcattggcaacagcgatttcagaaatgccgggtttcataaacgtcaagatatgtctgaaggcatcatctgcaatcttcgcagcttcctctaatatcttaatctcttcactagacttaatcaagcgcaacttttccacggattcagccacaggcactaattcggcatcactgataacggcgttgtatgaagcgtaagtgccatatgtcatgctgttctgttcaaaaccgagacgcttgatgccaaacgattcaacagtgtcggcagtggtctgaatcaagctgccgccatgttcaatgatctcaaaaccctttacctgaaccttcgcctgctcagtataacgaaaatccgtaataaacgctgctttgtcacccgatataacagccaaacccgccgaacctgtaaaccctgtcatatagcgtacattcgtgctgcttgtaaccagcatgccgtcaattcccagctgtccaaacaggtttcttaatttctctagcttcatcttgattctcccccttgctggcttaataagtagcgaacagcaagcttgtagccttcagctccaagaccgacaatctgccctttcgcaacaggagcgataaccgactgttgcctgaattcttccctggcgtataagtttgataaatgcacctctaccacaggaagactgatgcttgaaacagcatccctgatcgcatagctataatgactcagggcgccggggttcagaacaatcccgctgtattgctcctcagcctcatgtatcgcatctatcaaatcaccttcgtgattagactggaagaaagtgagctggatatgtaaggcttcagcaaactgaaaaagatctgtttcaatattggtcagtgtctggcggccgaatacttcaggctcacgactcccaagccggttaacattcggtccgttcaaaatcaaaaaatgaggcacataatctctccttttcgcgagggtttctcatgtaaaaaatgttcacttctcgtgaacattttatcatactggaaaaggattatacactattctctatgcattcccagcgcacgtgcaagcttttccgaattcagctcattgtattcaaatgaaatggaatacccgacaaacagcccgtaaagcaaataaatgcaaatggtcgtaataattgtatctgatgtcagttcggtcaccgtgcgcacatctggaaaaatcggattaaaaacaaaaaacacgagcagccaaagcaccaagccgtataaaatacccggccacattgtttttaaacgtttcaatagaagaaaataaagaaacgctgcgccaattgaaattactccaatcaaaatgatgctgattaccgttcccagcccatgttttttccactctccgagcacaaacggctgcaatatcatattcgggctgatttcggaaaaatgaaacaaatatgcgatataagcaacgaaactccaaagcacgcctccgcaaaaacctgttgccgccaccctgccggccattgaaacaggcggcccttgcttctcattcaattcttcattttgttctgtatctttttcgcttgtcatcatggcacctccagttaaagtgtgcccaaaaaatgaaatgtcaataaaaaagctcacactttttgacagctgcgagtaaaatttgaaaataacgggtataatgcatgtagaaaaagcaaggctatggcaattttttcagcctgtcaatctagaggtttagcgctgtttcctgtacaatagagtgaaaggaaatggttagcaatcctaaagaaataggcaggttgatattatgtcaaaacataaagttccgcccgcttacggcgggcaggctgttgtggaaggcgttatgtttggcggaaagcatcattacgttacagccatcagaagaacggatggaagcattgacttttttaagcttccacgcaaacacaacccgaaactgaacatcgtgaaaaagataccgtttttacgggggatcgctgccattatcgaagcgagtgcaaacggcacaaagcatttgaatttttcaagcgaacgttacgggctcgatccatctgaagaccagacacttgagcaggaagaaaaaaaatcttccgggctgtctatgtatctcagcctcgcagttataggcgtcctatcatttttgttcagtaaattcgtatttacattggttccagttttcttagcggaactgacaaggccgattttttcctcggacacggcgcaaatcgcggttgaaagcctgtttaagttgattttgctgctcggttacatctattttttgtccatgacaccgctcattaaaagagtgtttcaatatcatggagccgaacataaagtcataaactgttatgaacagaatttgccaattactgtggagaatgtccaaaaccaatctcggcttcattaccgctgcggatcaagctttattttatttacgattattgtcggcatgtttgtttatttattcgttccgacagatccgctttggctgcgtgttatagatcgtgtcgcactgataccggtcgtgcttggtatatcctttgaagttctgcagctgacaaacaaagtgcgtgacattcccggtctgaaattacttgggtacccgggtctttggcttcagctgttaaccacaaaggaacctaaggatgaacaggttgaagttgccatcgaaagctttaacgaacttctcagactcgaagaattgtctgagcaaaatcagaagccttctcacaacgtcatctaaaatccgttgccctgctattactttcggaggtggacagttatgaatcatcgtgtacaacctattattgctgtattaattgcgctgggagcgttcggtttcctctatgtgctggtaaccaatcccggagaaatggcaaaaatggcggtaaccgtcatcgtggcaggtatcattatttattttattgtgaaatatgtaatgaatcgaaatgcgggcagcgaaggagcagccttcaaaaaagcggcgaaacaatcgcggcgccggatgaaagaacaaaaagcaaaacaccgcgccggacataagggacgtgtcagccacctgcgaagcgttccgagcgccagcaagcctaagccgatgattctcaagaaaaaaagccagactcagctgactgttatagaagggaaaaaaaataaaaagaaaaacagagcacttttttaataggtccactgctttaaaaacagctctgtccgtcttttacctagctcaatcagggctagttttttttgttgtgttaaatgaaaatcagtggccattacgtcatcgacagggagaaaaatgatattttgttcatagcgtgacgcaatgtgccttgcgtcatgagcttccttcatcgtttcaaacagggcgccgaacagttcaaaagcgttgcggatattttttttcggacgctctctttcacgcggcgcaagcgtgacaccgatcacagggcgctttctttcctttgaaaacagccagattggaaaattgcttaacacgcctccgtcgacaaccgtggcggtgcctgtgtccgtttttaattttatcggttcaaagaaatacgggatgctgcagctcattctgaccgctctggcaaccgggaacatatctggatttaacccgtaacggaccaaatcgtccggcaaaacaatcatggtgccgtttgtcagatcagaagcaataaggcgcagagaccctttctgcaaatcgccgaaaacccttatgcctttcgctcttaacagatcagcaatccatttttctatcgtatcgcctttgtataagccaagacgccagtagatggacacccactggagcatctttaaggggagaaatgagtacctctgatccagcaatttctctccgtccacttcttcaattaaagcgtggatttccttactggtgtaacctgacgcaatgaaagcggcaataatggcgccggcgcttgtacccgcaactcttttaaagcggaagcctttttcctcaagcacttcataagcgcctgcgagcgcaatgccttttactcctccgccggaaaacacaccgtcaatatacatctcattccctccccctccatccgatcgtttattaccattttaagaaaacacgcgaagaaatagaccaacgaatgacgggtggcgtcagcgtatcaaaaaagacggcctccttcgagaccgcctttttactgattatgatgttctgttttcttttggattgatttcagatcttttttacgggcatcatcttcttcaaaatattgaacaagatccccgatgcgatcaatactgttccagcttaaatgatgttcgattccttcgacatcgttatatattttctcttcatcaacaccaatgattcttaaaaactgctcaagcaattcatgtctgtataccagccgtttgcctatttttttccctttagacgttaacacgagaccgcgatatttttcataaattaaatattcgtctttatctagtttttgaaccatttttgttacagaggagggatggactgccaatgcttccgcgatatcggaaactcgtgcatatcctttttcttcaatcagcatataaatctgttcaatataatcttccatacttggtgttgtcatcgaaaccctcccaaaaagcaccttaactttataaaccattacaagtttacactaatgaacttgaaaaaacaaggatgctccgcgggtcaaaagccctgtttaccgcttataattccattcatctgaagcgtactttgtttcagccaagtgatgaacaaaatcaagctcttcctgagaaagttcatatggctccaaatgaatgttaagacctgtttcaaatccttctttaaaggctttacgagcctcatccatcgtcacccgcttttcggtgagttcattaatggcaaccgctttatttttgaaattgcgctgcatccgctctcttactctttcacttggatataagaacagatcgaacagcttgtcctcatccaaatcaagaagaatggagccatgctgaagaatcacgcctttttgtctcgtttgcgcgcttcccgccaccttgcgcccctcaaccactagctcataccacgaaggcgcgtcaaaacaaacagatgaccgcggattttttaagctttctttttctttttcagttctcgggatggcaaagtaagcatccagaccgagatttctaaagccttgaagtatgccttctgaaataacccggtaagcctcagtaacagtcgccggcatctcggggtgctcttccgaaacaattacgctgtatgtcagttcctgatcgtgcagcacacctctcccgccggtcgggcgtctgacgaatcctagattatatttatgtactgcttcaaaattgatttcctttttaatattttgaaaataccctacagaaagtgtcgccggattccagccgtaaaaacggataaccggggggattttcttttcgctgtgccaatataaaagcgcttcatcaagcgccatattgaatgcaggacttgcattgcctgagtctataaaccgccaagtttctttttgcattttaagaccttccttaccgttttaatagaatcagtttatcaaactgtcgggaaaatgaaaaatattttagttccattatagatgacaatcacgctgtgctttactataatagtatttgtcgaaaacggctctatgaccttgttttatgaagcagggttttgattttatatgctaaaggagtagaatcacattgtctaatatgatcgttttgattatttttgctgcgtttatcatctatatgattgcttcatatgtctatcagcagcgaattatgaaaacacttaccgaagaagaattccgcgcgggttaccgcaaagcgcagcttattgatgttcgtgagccaaatgagtttgagggcggacatattttaggcgcccgcaacatcccgctttcccagctgaaacagagaaaaaatgagatccgtacggacaagcctgtttacctgtactgccaaaacagtgtccgcagcggacgcgcggcacaaaccctgcgcaaaaacggctgcactgagatttacaacctaaaaggcggctttaaaaaatggggcggaaagattaaagcgaagaaataaagcaaacagctgtctggtagacagctgtttttatttatctttctaccgcctcgtatctgagcaccgggtgtctcgccgcttttgtttcatccattctttttacaatcgttgtatgcggggcctcctgaacaagctccggattctcctccgcttcttttgcgatttgaatcatagcatcaataaacgcgtccagtgtttcctttgattcggtctccgtcggctcgatcatgatgcattcttcaacattaagcgggaaataaatagtcggcggatgatagccgaaatcaaggagccgttttgcaatatcaagcgtacgcactcccagctttttctgccgcttccctgataatacaaattcatgcttgcaatggcggtcaaacggaagatcgtaataaggcgcgagctttctcatcatataattggcgtttaacactgcgttctcagtaacagcctttaatccgtcaggccccatggagcgaatatacgtatacgctctcacattaatgccaaagttgccgtaatacggcttcacacggccgatcgcatgagggcggtcataatcaaacgtaaagcgcccttcttttttaactaaaactggctttggcaaataaggaatcagatctttttttacgccgacagggcctgagccggggcctccgccgccatgagggcctgtgaatgttttatgcaggttgaggtgcaccacgtcaaatcccatatcaccaggtctcgctttacttaaaacggcatttaaattagcgccgtcataatacagtttcccccccgcttggtgtacaatttccgccatctctgtaatctgctcctcaaacaagccgagcgtgttcggattcgtcagcatgagagctgcagtttcttcattcactgctctttttaaatcctctaaatcaacaagcccattttcattcgatttcaccgtaacagtttcaaagcctgctactgtcgctgatgcaggattcgtcccgtgcgcggaatcagggacaatgaccttcgtccgcttgaaatccccgcgagcttcatgataggcacggatcatcatcagccccgtccattcgccgtgcgctccggcagcaggctgaagcgtaacctcatccattcccgttatttcttcaaggtgcttgcttaaatcatataaaagctctaatgcgccttgcaccgtgtcttcatcctgaagaggatgaatcgcagcaaaaccaggaatacgtgcgattttttcattgattttcggattatatttcatcgtgcaagaaccgagaggataaaaaccggaatccaccccgtgattgcgtttggacagcgctgtataatggcgcatgatgtccagctctgaaacctccggcagcgctgcgtcttcgtcacgaatataggtgtctgacaagaggtcccccaattcgatttccggtacatcgagctccggcagactatagccgattcggccttctcttgaaagttcaaaaataagtgcctggtcctgattactcatggcgatcccccaattcctgaatgagtgcgtcaatttcttcttttgttctcagctccgttacagcaatcagcatatggcagtccagctccggatacgtcaacccaagatcatatccgccaatcatgccttttgccagcaaacgcttgttcacagctctcaccggctcatccagtttgatgacaaattcattaaatatcggcccgtcaaacataacggtaagacctgctttttttgcttcttgctttgcatagttggcttttaagagattttggcgggctatatcttttacgccgttttttccgagagcagtcatggccactgatgctgccagcgcatttaaagcttggttcgagcatatatttgatgttgctttatctcggcggatatgctgctccctggcttgcagggtaagcacaaagcctctttttccgttttcgtcttccgtttgtccgacgagacggcccggcacctttctcattaattttttagtaacggcaaaaaagccgcaatgcgggccgccgtatgctgaaggaatgccgaaaggctgcgcatcaccgacgacgatatcagactgaaacttgcccggcggagtgagaagacctagcgcaagcgggttagctgaaacaataaacatggatttcccttggtgagcgataggctcaatatcctttaacggctcgatccggccgaaaaaattcgggtactgaacgatcactgcggctgtgttctcgcaaacggtttggcgcaatgcatcaagatccgtaacgccatccgcagcgggtacttcaacaacatcaatatactgaccttttgcgtacgttttcagcacttctcgcgattcaggatgcacggtttttgacacaacgatttttttctttttcgtgtggcctgaagcaagcattgctgcttccgccaaggctgttccgccgtcatacatcgaggagttggcgatatccatgcctgtcagttcacagatcatcgtttggaattcaaaaatagcctggagctctccttgtgaaatctctggctgataaggcgtatatgcggtataaaactcagagcgcgaaatgacatgatccacaatgacaggctgatagtggtcatatacacccgctcctaagaaagaagcgtattgtacggtatcacgatttttagaggccagcattgtcagttctcttgttaattctgtttctgatttcgcttttttgatttgatactcttttttatatttgacgttttccggtatatcagcaaataaatcatcgatgctgcttacgccgatagtagcaagcatctcctgtttatccttttctgttgcgggcaaataacggtgcttcatgtgttgtctcctctctccaagaaaaaatattagcgtttataaaatggtgttttgacaacctttgctttcactaattttttgcgaatctctacatctacaacagtcccgatctcacttgtttccgaatcaattaaggcaaggccgacgtttttccctaatgtcggtgactgcgtgccggttgtcacctttccgacagacttgccattttggaaaacctcatatccgtgccgcggtatccctttttcaatcatttcgagaccgacaagtttgcgcttcgctccgttttctttttgttcactcaatactgacttaccgaaaaagtcagactcttttttgtgctttacagcaaagcctataccagcttcaatcggtgtaatatctcgggtcagctcctgaccgtagagcgggagcttcgcttcaaaccggagtgtatcacgtgcaccgagaccgcatggaatcaatccgtatgcatcccctgcatcgatgatttttttccaaatatgcatagcatcatcactgcggcagtaaatttcatacccgtcttctcccgtatagccagtgcgtgaaataagtgctttgcggccgctgatatcggcttcatcaataaacgcaaacggctttaatgcagacacatctgcatctgtcagattttttacgaccgcttctgctttcggtccctgtacagccaagagcgcgatttgatctgactgattgtcaatctgcacatcacctgctgcatgttctttcatccaagccaagtctttatctatattagaagcattaatgacaagcagatagcggttctctcctttttgatagataagcaaatcatcgacggttccgccatccgggtaacacatcgctgtatattgagcacggcctggcgttaacgcggaaacatcatttgtcatcaatctttgcaaaaaagacagactgtcgttccctgacacttcgacttctcccatatgagatacatcaaacaaaccggctgcagttcggacagcctcgtgttctttttttatagaagaaaattgaacaggaagctcccaacctccgaaatcaatcgtttttcctccatattccttatacaggtcaaataacggcgttcttttcagcatctaattcctcccctttatcaacggcgcagctaaaaaacatacaaaaaaggacagagaaacacctcatgtaaaatgaaggttctctgtcctggcacctgaaagtttactttgcatacgcaaagacgtcccctttggtggtttgcgcatccgcacaaacactctccagagttgcgtcgagcaagagttcttttgcctgagagattcactccgcagtttgctccttcggcgcctgtatcccgaggttttcggtcaggtctctccccttgctgtcattcgctcatattttcatgctgttatggacatactatagcaatatcttacatcaaatacatactcatatcctaccatcatcactatatgctgggcaacagcaatttgggcagatttttctaatattattcatcttaagaatcgaagaataagaaaggcggtttcaaagcaatgaatacagaaatgatctacgatgcaaaatggcctgaagaatttgctgaaagactgaaaaacgatggcccttgggcaaactgggaactgtacaagctctccgcagaaatccagaaaacattagcaattccagagtttgaaggtttacgggctcctttatatctgccttcctttacgccgctcccccaccagcttgaggtggcgcaaaaagtggttgaaaaaatgaacgggaaagcgattttagcagatgaggttggtctcgggaaaacggttgaagctggactgattctaaaagaatatatgattcgcgggttagcaaaaaaaattttgatccttgtgcccgcttcccttgtgtcacaatgggtcaaagagcttcaggaaaaatttttgattccggctgttgaacaaaagaaaagctatgtgtgggagcaatgcgatattgtcgtctcatcaatagacaccgcgaagcgctcgccccatcgcgaaatcgttctgtcaatcccatatgatcttgtcattattgatgaggcacacaaactgaaaaatagcaaaacgaagaactatgaatttgtccggaatctcgtaaaaaaatattgcctgcttcttaccgcgacgccaatccagaaccgtatcgaagagattttcaatttggtgtccttattaaaacccggccatttaggcagtcagaatcactttcaggaggagttcgccaagaagaaatccagtttagaagcgcatgaacatttaaaagatcttgtgaataaagtcatgatccgtaacaggcggcatgataccgggctgaattggaaacagcgccatgttgaaacagtgccgattgaattttctccatcagagcaggcgctttatgatgaaatttctcgtttgaaggaaagtatcaataaaccagccagcatgttctcgattatgaccttgcaaagagaatgctgttcgagcagagaagcggtgtatatgacgctgaaaaagatgcttgatcaaaaagagaaacaagcacctgccattgatgaggatacgatttcagttttaatagatcgaattaatcaagtgacacaaaactctaaagcgcttcaagttgttgatttgatcaaaaagatcgacgataaggtcatcatttttacagaataccgtgcaactcagatttatctgcagtggtttcttcagcaaaacggcatcagttctgtgccgtttagaggcggatttaaacgtgggaaaaaagactggatgaaggatcttttccgcggaaaaatccaagtccttattgcaactgaagcaggcggtgagggaattaacctgcaattttgcaatcacatgatcaactatgacctgccatggaatccgatgcgacttgagcaaagaatcggaagaattcacagactcgggcaggagcgtgacgtgcacatttataacatggcaacaaaacatacggtggaagagcatattctaaagcttttatatgaaaaaattcatttgtttgaaaaagtggtcggcgaacttgatgatattttaacgaaaattcaagtgaacaattttgaagagcaccttcatgacattttgtatcactcagcaacagaagaagaaatgaaaataaaaatggataacttaacctcatttttgtcttataaaaaacagcagcctgctgaaaaaagaggatcttagcctgtaaggaggttttactagtgagacagcaagaggttcacgattttctgctgcgtttttttcaagcaaacagctgccaaatcgtcgatcaaggcttaggctatatgacagtgcagcttacagttgaaatggacaaacaaatcatgaaccgccctttctactggcattggcgcgagaagacaggcggtgatccgaatccaatgaaaatcacttttattacagataaagaaaatgcgccaaaagacctagatggtgaatttatatattttggggccccgcgtctttttcaaatatttaaagctgttaaacaaaatgggagatttaccagaatgtatgagaaaattgaatcagccggagccaaagtcccacttcagccttggcttggtataaatgtcacgatttcataccagtccgacatgaaaaaggataagttattatcactaggtcttcacctagtctctggaacgataattgaagattttcaaagcaagctgactcagctttcactgacatcacaaatatgtgactattgcttcaccatttcacctatgatcaaaccagaaagcggacttaagcgtatggaaaactatatttccaaatccgctatgcaggagccgtccgactgggcggaacaggcggttaacaggtggaagaatgatatgacattgcttgataagttttacgagcatatagaagaaaaaccagaagaataccgtctagaaaaacaggcgctgaaaaccttgtatcaaccaaagatatcagttgaaattgaaaatggcggattattttatctgcaaaataatatttcaagctaacttttattcattcgacatcgttctcgttttttttgaaaaaatgcgattataataaaggtatattggaaaaaaattctggcatttttaaaggggaaatgacttccagagactaatgaagcatacaatgagtcatggccggactggctgaaatacataaacaagtattttaggaggagaaactgcatgaaaaatgcaaaacaagagcactttgaattggatcaagaatgggttgaattgatgatggaagccaaagaggcaaatatcagcccggaagaaatacgaaaatatttacttttaaacaaaaagtctgctcatcctggtccggcagccagaagtcataccgtaaatcctttctgaatgtgctataatatcacaaggaaggtgatgacattgattggccagcgtattaaacaataccgtaaagaaaaaggctactcactatcagaactagctgaaaaagctggggtagcgaagtcttatttaagctcaatagaacgaaatctacaaacgaacccctccattcaatttctcgaaaaagtctccgctgttctggacgtctcggttcatactttgctcgatgagaaacatgaaaccgaatacgatggtcaattagatagtgaatgggagaaattggttcgcgatgcgatgacatccggggtatcgaaaaaacaatttcgtgaatttttagattatcaaaaatggagaaaatcccaaaaagaggagtagtgcctgagcagaggcactaactcctcttttgtcaataaacatcgagacggcccagtgataatttactgggccgtctctttttttgctgttattaatttttatcctcgctatgcgctttttcattttctttcacgtaaccgtctttatcagtatggtcctttttgattgtcaagccgttccactgtgtagcttcgaatgagaattgaagcttaatggagttgccttgatatttattttgaaccataagcccgttttcatcttttgttttatcatccttgaattggatttccatttgaacctgatcgaagtcagttggtgtttttggaacaccatcatattcaggagcggttttaccgtcaattgttgctacattgactttaccgcttgcatgtaagaatttagggtcaatttgttttttgattttttcagcagccgctgcatcatttttagcagacatcaaatacaagtctttaaggttcgcatcatctaaaataatgtttttcgggtagccattgccgccctcttttccaactgtcaacaatgtcacttcaaactggctgaggaaatcttctggagatgtattgctgccgccatttgctttaaaatctccataattaagcgccattaaaacttctttgatcgcaagtgatccgttattttcaaattggaaatcctttgtcaacttatctcccggctttagatttgataagttcacactcgctgaattttctttagcagataaatcaagcgtacctgatgcaaaagtagcatcctttgatttaatgtcgttaaatgctgcccatgttcctcctccaactaaagctaatcctagtgctgcagaagcaactcctaaactcaatttctttttcatacccatggttaaaactccccttttattgaatgttttatatcgaaacctgttgccaggtttacaactgaagttaagtggacatggtgctgtcctttgtatctgtttccaaggcttttgtctttctttcaatttctctaatggcgctgctgatcgtcacaaaagcgtacactaacagcatcacgccgggaacaatcaataatacagccgttccaatcggctggctggcaaaatgaagcatatagcctgcatatggaagctgaaaacctgtgtattgcgcgcgaacattttcgtccgatacaggcgctgaatcagctgctgcattattatcaccttttgttttaaataacaaatggtctccttgctttgttatgtcaacaattctgtgggtgaccgccgtatttgcatcctgcataaatgtaataacgtcacctttttgaagctctttcacatcagcgatttctttgaccaatattaaggaacctgtattgaactccggctccatcgaacctgacagaactgatttcaatgtatacccaaacacagccggctctcccccggatgaacgtgttgaaatcacgacaagtgtcagcacaataataagagtaaagatgatcacgtataaaatattactgatcagcttcattgcttttttcatcctcttccccgctttccttctggtctgattgagtttcattttctttggttacagcttcttgagatgtttcttctttcattgttttttcctgtatatccttttgtgttgtttcattctcctttttgacgtccgactttgtttcttttttagggacagtcggtttttcatcgcattttgcaagcgtcataggctccgaccactcaaatgtactgccgtttgccgggtagcctgccggtttatatactttaaatgcataaatgccgggtttcatttttttcttggtctcaattttataaagtgaatcgccgatttgattggagacaaatcctttttcgatcacgttcccatcctttaacggtttgcgggcattttcaagcttatgaagctcccacttccactttgatttcttaagtttctcacctgtattttcgagcacagcaaataaggcgaaaggtgagcatacagtgcctttcgtatccgtttgatctgatatgtgcaaatcactttgatcccagcgtttatcataatggcagtttttatctgtatgctgaaagtctttacacgtttgaagtgagacatcaaatgtttcaatatcatgaaaagcagcgcttgtatcatcggaaaattgtaagcatattgcggcagtcagactgaaaatgactgaaagctgaaagataagcagaactttcagtttcgtcttcgccttttgctgattgtaaaacaatcgaaacatatcttacctcctgtaaaacactgtaacttgatatgacaaccgttctctttaaagaacttcacaaatagagtataatcaacgatttatagatttaaaaacaccgaaatcgctcatttcgttcgtttaaaagaatgttttcatcatattacaaagtcttgctcagtattgctcattttttcaatttttttgaaatttttgggattgttatgtgagaatttaaatgcatatcccattattatttggtaataataaacaaagaaagggtgacagcatgatgatcaaacaatgtgtgatttgtctatctcttctcgtctttggcaccacagccgctcacgcagaagaaacaccgcttgtaaccgcccgccacatgtccaaatgggaagagattgctgtaaaagaagcaaaaaaaaggtacccgcttgcacaggtactgttcaaacaaaaagtatgggaccgtaaaagaaaagatgaagcagtgaagcaataccatttaactctgagggaagggtcaaaagaattcggcgtttttgtgacgatttcatttgatccttatagccaaaaggtcaataaaatcgccatattagaagaatatcaataaggtcctacattttttgaaggaccttattcgtttatttgcggttattttttccgtttcagccaaagtctgaagccatagggtaaaataccgaacaactgctgggaaacaggcgtttttgtttctttccgcacctcttttcgttcttttcgctcatctctcggagtatctatatatttgacaaattgctgcgtcatatatttaacataatcattcgttttcacgtgatcacctcatcattcaattattatgaagtgttgtctcacatgactttttttataccctttacactgttttattctgtccatctcagcagttttttctgtttttgatcaaatacgatctgtgcagttctttctgttcccgactccgttgacactcttaagttgatttctttttgttcttttatcgatgtatcatgaatgtaataagaaacccgtccatatggaaattgctgcgtaccctcctggcctttccgttcctctagaacatgccgaatcgaaagaagcaccccattttgaagcaaattctctcctatgtataactcttttgtttccttttcaaacatgcagcgtgaaatatattgagcagcagcaaagttcacgattaacagcacaagcgctgacacaaaaagaacagctggataaataaaccctcttgtacgatacattcacccccctcctaaatacgaatagactggaaaagcagtttgatacactttttggtcctcactctcaattttcagcaaaacaacaccattttcaatatcagctttcatggcagtaatatgatctaaaatcggaacatgccctttaccatccactctttttcttatcattgattgataaatgtcaaaacggatgtcttgtccggaaagattggtgcagattaacacgctcccatgctcggctgtcttaactgcctgtgactccttgcattcattcatcatctgttctatcgaaatcatccattcttgctgtgtgaaaccgtcatgttcctgctgtcgagacaaaaacagatggaaaatcgcagctaacgatcctgatatgagcaaaaagactgagagcgaaaataatacgttaagaagcgtgtagccattctgtctgcaggatgctgaggcaaaatgattgttctttataagctgtggctttgatacatacgttttgatattcgccctcctcctcccacttcattgcgtagatatgattgttctttgtaatcgtttttgacgcggctccttcaccactcatgacatatttgctaatgctctcattcatcatctgatagccgatttctcgtgattccgccattttttcatcagccatcagcttgtcccacaaggggacgactgtcagcagcacaaacagccacaggcttagcgcagacattgtttctattgtagaaaaacctttattttctctccacattgactctcccgctccctagataaactgttatgtcataaacggcatgcccttttactcgtatttttccgcctgcattcgggtgccctttctcattaaattccaaacggtcttttaatgtcagcagttctatagaaagtcccgttgcatacggacgttcaatgaccgtatcaccaatgactaattgatattcttttttatgaaagagaatttttgttctttgttgacgggaaatagcagtctgctgtgtgagcataatatcatttttcagctgccttgctgcctgtcggacagctgtattgtcataagcaggaggaagtgtggtgaagacggcaatcaggaggatagaggcaaggcttaacacaagcaaactttctaaaagggtaaaccccttctcctcgtttaatttaatgttcaaccttaacttctccgccggtgatgataatgcgcttcccatttggacagacagcatcctttttcacatagccctctgactgtaaatcggcaaggctcggagtttgtccttcatgatcaagctcaaatgcagtcatttgtgccttaaccatgttttgtaggccttcacagccctttttttgaatggtttgattatgcttcgtgacgttcggtatcgtaattaaaagcaagatcgaaataataaagagcacgattaacatttcaacaagtgtaaatcctttctcattcatcagcctcttcctttcacatttgattcatcatctgatacataggcacaagcatagataaatacacaagtaagatcatcgctgcaacaaatccataaatcattggctgaaggatgcctgtccatttttgcgctttgtgttccaggcgctgtaatatgaattggctgtatgtgaaaagctcccgatccaatcggccgctcagctggccgtgagatatgacttttgataaatcagtttcataaaaagggcttccacaaatagcggattcaattgactcaccggcttttagccgttcaatcaattgttcagcctcgcagcggtagaaagggagaaacgtttgatgtttaaatgcattaaggctgtcataaattgagaggcctgattttaaaaggctgcttagctgcaaagaaaaaaagtagctgttaaacagctttacaagctttccaaccaaaggaatcctgatacaaatcagcatttgccgggcaggtgattttttcttaaacacaagccaataataaatcccgatacctgctgtaaaaagaacaagcaaaatgatcacaagatcaatatgctgaaaaaaagcaaaaagcatatcggttgaacgtgaggtttccatattcatcgattgatagataccggaaaactgaggaatgatgatggactgtaacatataaaacatgacagcgaccgtaaagatgaggaaaagcggatagcgcagcactcttttcagctggtctgcctgtgcaatttttcgttccagcagctctccgctctggatcatggaagcaggcagttcaccatgtgtttcagcaaaataacaaatacctacggcttccttatgaaatgacaaactctttagtacttgataaaacggagccccttccctcaaacaagtgaccgaaccagtcaagtcagccgcctgcctcttattcatctgaagttccatcaggcgtaatccatccagaagcgtatatccgcccgcagtcatttcaccgagcctctttaataacctggcttgatcctttaacgaccagacttttctaatctttttcatgataaacccaccggtcatagttgtttgtcgttaaatagccgagcgcaattcctttcctgataatttgacgaagcgtttgatattggtaatttgcatgatttccttttgcctcctggatacattgctgaagatttttcccgtaaagaagctcataaacgctagctctcctggtatttcgtgactggcgacaatacactgatgaacatccgttttcacaaaacgggcaagccaaatcaaccaagcgctgagccgctattgcaatgacagtctgttcaatttcattcatattgataccgaattcaagcagtctgtaaattgcgccctttgcgtctctcgtatgaaggctcgttagtaccagatgtcccgtcatcgctgcccgcaccgcaatttcagctgtttccgcgtctctgatctcacctaaaataatcatatcggggtcatggcgcaaaattgctttcagacctgcggaataagttacaccggctttttcattcacctgaacctgaagaacatcttcgtcccttgtttcaacagggtcctctaatgtgacaatatttcgattaaagtgtttttttgcatattgaacgagagagtatagtgtggtagtcttccctgaaccagttggcccggtaaaaatgagcatgccatgggaatgttttaaaaacgagagtaatgtggctcctgtcttcggaaatagcgacaatttatcaatcgaagggatattgtattggggcatcactctgatcacgaggctttcttcattaattgtgggcagcgttgacattcttaaatgaacatttccctctttcagctttaacgtaagcgaaccgttttgcggctttcgcctttcacctatatccattgctgaaagaaatttaaaatgtgaaatcagccttacgcactcttcttttttcatgtccctttttttcagcaaggcatgatcgacccgaaaatgaatgatagcgtcccgctccctcggcacaatgtgaatatcagaagcctttgttagatatgcttcttcaatcaagtttttgcttaccttttctattgaatccaatttgattccctctcctttcaatgcgtattgtagaaaaagaaggagcggtaatcaaacagggaaaacgtgattttgtgagacgttatatgctgaaaaatcccttctttctggcaagaaaaagactttcaactgaatgtacccctgtcattataattttccctataaataaaaaagcagacatggtcaccatgcctgctagattccattttcattatgctgttttcgctttttgaccagtatctttctcaacggaaaggtcgcctaatgcaacaataccggcaatttggccatattcaagaatcggtaaacggcggatttgatgctctgccataagcgccttgacatcgtatccggtcaccctgatatgtctggtgaaaaagcggggcacgctgcacaaaatatgaaacatcctatagagtccgcctttttcgaggtttctttttcttcttccgctcctgcagcatatctcccgtccagccttttttcctcaaatagagatagatcagaactgtagatgtgacaatcaataagagagaaaagagatatccgtatttccaattcagttccggcatcactgaaaagttcatcccccataaggcccccagagctgtaatcggcgtaaaaagcgtcgtgaaaatggtcagcgcttttacaatttcattccccctatgtgaggtaatgacttcctctgaatgcagcagattgttaagctccccttcaaattcgctgatgtatgtaaatcccctgtcaatcttcagttgagtccgctgataatcctttttctcttcattttgaggtaaaaaggtttctttcaacgccatttcaatttttttagcgcttagtatcaaatttttccaaatcatcagttcatggcgcaggagatggacgcggtttaaaatgcttttgctattgtcgtctttaatctgccatctaagctttctcagctttacttcaaattcatcaacaccgattaaatacgcattcattagttcgccgaaaagaattaaaaacccctctatcgcattgtccgctctttccatttgccggacaacttcttttcctttaatctctctcaaaattgaaaaatcaaagttgattgtaaaaaaatattgtctggtgatataaaagtgaaaaacagtatggtctttttcttcaccaagcccctgatcataaacaatcgacccaaataccgcttcattttccgtttcagttgtatctactcgtaaaaaattaacgtggtggttattttcaaaccacttttcacactgaggccagtgagaaaaatggattagatcccttgccttacttctttcttgaggccccatttggtaccaaaaccaatcctttcccgtatgtgccttcatgtcaagctcctccaaacttttgttctttattctttaattgcccaataaccgcgtcactaaaccagtctgccgcttcaacacatgttttatgagcattttcaggtggtatggaatgtagaaagacatcggaaaagggaggtgcatgccttccttggagaaggcagttgttttggaatttgtcaatttactagcagtcgctattcttattttgttaacaggattttttgttgccgtagaattttcaatcgtaaaagtgcggcggtccaaaattgatcagcttgtcgcaaaaggaaagaaaggtgctaaagcggcaaagcatgtcatcactcaccttgatgaatatttatcagcctgtcagctgggcatcacagtcgcagccttaggactgggatggcttggggaaccgactgtgcaaactctgcttcgaccgctttttcataaagcaggcttaaatgaatcgcttacccacctgctttcactcgtcatcgcatttttagcggttacgtatttaaatgtcgttatcggggagctggcgccaaagagtttcgccattcaaaaagcagaaagcattaccttgttgttcgctaaaccgcttatttggttttataagatcatgtttccattcatttggctgttgaaccactctgcccgattgattacaggagtgtttggactgaagccggcatcagagcacgagctggcatatacagaggaagaacttcgggtcctattggctgaaagctataaaagcggcgagatcagaaaaagtgaattaaagtacatgaataatatctttacctttgataaacgaatggcaaaggaaatcatggtgccgcgaaatgaaatggtcagtttgtcactagatgaagactccatttcaaatcttcaggaaacagtcaagcaaacaaaatatacacggtacccagttgtaagagaggataaagataacgttattggcgtgattaatatgaaagaagtgctgttttccatgctgaacaaagattttttaatcaagaagcatcaaattgaacctttcgtacagcccgttatccatgtcattgagacgattcctatttataaactattgctgaaaatgcaaaaggaacgcactcatatggcgatcctcatagatgaatatggcgggacgtccggtttggtcactgtcgaggatattatcgaagaaattgtaggagaaatccgtgatgaatttgatgcggatgaagtgcctcatatccgcgaacttggaaaggatcattacttgttaaatgcaaaattattaatcagcgatgttaacagcctgcttggaaccgatttatcagaggctgaagtagacaccttgggcggctggtttttgacacaaaacatagacgctgagcctgaaagtgccatagaatatgatggctactcttttaaggtaaaagacatcaacagccatcacattttatttatagaagttaaaaaagctgaatagcccgtgaaaggctgttcagctgctatctttcaagataaacatggcaaaggcatcaacactcttttattttaaaccctttattggccagggctttagcaagactttgctcggttttcacattcgaaaaatccagacccagcttcacgacagtttgggcaatttccggcctgattcctgaaataatcgtctcaatgccgagcaatttggtgctgtcaatcactttaaaaatttgataggctaccatggtatcaacgataggaacgcccgaaatatctaaaaataaatacgagagctttaacgctgagcactgctccagcacagactccaaaatcgtcctcgctctgtgcgtatcaatttcaccgacaagcggaagaatcccaattccatcagtaatcggcataatcggcgcactcaattcattaatcatttctttttgcgcgtttaattgtatcatggtcacctggtgatattcttccgtaaatacttcgatgatctcatcaatgttttgattcaagatccggctccactcataaaattcctgaatgctgatgtcttgagaagaagcttcgctgaatttctgaatccattcaaacatgatgtgcctgaaggtgttaaactggccgacactttgtgtaaccgtcacttcatgaacggcacggtctctggcgcattgaagagaccaccggttgagctcatcctctacgtcttcttttctaagggattttgctacgatggtcaccaataattcatgctggtcttttaacttttgttctagtttttgctgatctttcgctgaatacagccagctgccttttgacgtacaaacttccagccattgttgcgtgatatcttctttgtgctctgttaagtgctgatcaagagctatcatcttaatgagctccctcctgtttttgaaaaatgtacgctatatatgtataacgcgtctgcctttacacatactatgtttagattcaatgggctatagccaagcggtaaggcaatggactttgactccgtgatcgttggttcgaatccagctagcccagtttctgaacaggtgaaaaaccgaagataagctgattcgaataaatcagcggatcttcggtttttcatcatgcagattgatgaaccgttttcttcttcgataacttcaacagttctcccgggttataaccaatcaccagctttttgttgtctactagaatcgggcgtcgcaaaagcttcggcttctcgattaaaagttccagcacctcatttaccgtcatttcttcaatgtttaaatttaaatttttgaaagtctggcttcttgtcgccaaaatttcatcaattccttctgtcgttaacgataaaatgtactttaattcttctcttgtcggggtttctctgaataaatgccgttcgttaaattcaatttgatgtgctttaagccaatgttttgtttttcggcatgacgtgcagcttggatatgagtaaaaagttaattgttgttccattcgttttttcctcctcagttaaccatctctttgtagaataactacccggatcatttttcatttaaaccatttacagaacttttttcggattattttttaaaaaacattcatacaatagaaaacacaatcaaagggacaaattccatttgtatattaataatgaaaatgtttacatttctaggtgtgatctattataataacagtcagagggactctcgggaggggataaaaatgaatcgcatgttccgggtgttaggattttggacgggaatttttgcagtcatgttttatttaggtgatatgaaagatgcttcccttttattttttggacagacgatcttattcgtgtttctatcgtatttgaacttaaccgaacgcatgtatatttatatttttggcgcttatttaacaattttcttcgccggctttacatattactcaatttttattatggtgcccggcggcggaggccattaaatgcagaaagagacaaaccttatcggtttgtctctttttttacaatgaaaaaccatttaaaaacggattttggtcctgctcagtcagtacgtttgtttcaggtccatggccgcttaacaccagcgtgtgttctggaagcgtaagcagtttttcatgaatggacgtcagcagcgtctcttgatcgccgcctattaaatccgtacgtcctataccgccttggaacaaaacatctccggagatgaccaagtctgcatctttcacgtagtaagacacactgcctggtgaatgtcccggcgtaaataatgtttccaaatgaaacggcccgatattcaactcaccgtcgccttcaattagatgatctgcaggcttagctgtgacttctatccctcgcagcatgccggagccgtttaaagaagcgtccgtaagccaatttttttcattttgatgcaggtaaacagggatatcccatttttctctcacttcatcaagcgccccaatatggtcaaaatgggcatgtgtaagcaaaatggctaaaggcgtcagccctttttcttttatgtattgattgattttatgtccctcgccgcccggatcaaaaatcaggcattgatcatcactgatgagaaaatatgcgttcgcttgaatcggccctactggcattcgtctccatttcactattatcacctctttcttttttatgctcttattatgagggttttttaaaaaagattcaaacaatcgcaatgaaaacgctatcgacaaacctataaaaaacaggtagaataaaactggaaagaattgcaggtttttcaatgtaaagggggctgtgttatgttacttgtcgtgattttcggccttgtcgctcttttcgctttatggggagtcttgcgttctgttagaaataaaaatatactcgggtttttattagccggtgccaccttatttgtctttggatggtttaccgtgatgaccgtaataaacagcgggtatccaaccgcacattaaaacctgtatccgatcggatacaggtttatttttatggctgtaaatgtttattgacactttctattttgctctcaagcgtcgtttttttgtcacgcctgtcatcgatacggatattcgttgccactctgtgcaatcctttttgaaatggcgcttcgtgaattgcctgaatgactgcaaaaaggtcactgagttctccctcgatcagcgtattcatcggtgtcagctgatatttgattttcccttctgcttgatatccttctaatatcttttgcacatcggctacgtaagcactgacactgggtgtttccgtaccgattgggataatggttacatctgcgatagccatcgttattccatctccttttgatcaatgatgagttgcttcgtttcatgtgatttcaataaaataatttgctcaaaatgaaagccgtataacgcatatttcccgttcggagatatttgaatcggctccatttcccgcagagacacaagatcttttgtctctcccgatgctacattgattgctgcgagcttatatgcatcgccgctttgtttgaatgtataaaacaggcctcctgcttcatcatagtcatactccattggagccaaatttgtatatttcgcttggagcggccatttcgctgtaacaggtgatgttgattgcggcgttttaaactgatacgtcccttttcctccggaagctgatttgacagtaaaactcatttgatggaaagaatcgaagaatagaacgtcatcctcaagcttctcttccgtcttagaagctgtatcgaacgtatataaaggccctgttttatcgtctcttccctcttttacataatcaaatgtatttttggatgtccaatgaatgaacggaacctgtactgggcttaagaaagattcgtcttttttagcattcacctgatatgtatggaaatcccagttttcattgaattccgtcaccatcatttgataaggatcatactgattccaagcagcctcaagctcatacgtttcgtaatctttttcgtaaagcgtctctccttctgcattaagcaaaaccactgctgtcttttggctatgtgtgatttgcagcagaatcatctgctccctcgcattgatttgaacatcaacgatttgaccatccgtttgatagagctttttcgctttgcctgtaaagatgcggtacgcaaaaagctctgttttcgtcggattagacgcagtatataatattgtgctgttattcagccagccttccgccccatccgctttttccgaggaaagcggtatgatgtcttttttctcatcttttgccgccgatgcctgtttttgctgctgatgagatggttcgcatgccgataaactaaacagcaataccgccagcagaataaaacaaactgatctcatcagcattcccctccgatcatctttattctctcatatttgcttcagcagaaaaaagaaaaagtttcagttactcatgaaaaaataacgccctccacaagatgccgtttgtggcgttatatatgtgtgaaaactgctgaaacggcaaaggattttggccttttccaagttccaccgtatacccttccttaaaataatggtgaataaaccaatcacgaaatccagcatagctgtctatatcccttactcccttataaatgttcccgcttaactcctcaaaatcctttatcacggcagcagattcctcaggctcaaggcctttatagccccaataaatttcttctccttgagtatgaagagccagcagtctgtcaggcggattctccgtgatcagccggtacatcgcaatagattccggctccgtaagcggagagattcccggaaaatcgcggtagctgggtgctgccggttttcggtatttttcaatttcccataatgatggaaattgtttatttaaatcaaccccgtttatattcgccttccattcattaaaattcggacgatgttcatttagcctttcgagctcatctcttctggctcccatgacttctgatccgtttaaaacaagatcaacgccatccggattgacaagaggaacgagggataaggatgtgctgttaaacagctttatgggagaaaagccaaagaaaggcgaattgcagcataatgacatacagtattccttaaaccattttagcaggacagacgttgtaatccactcattcgcatgaaatgacgcgttcatatggaccttttttacggcatgctccccaccagccttcagctcccagataggcctgccgagtacagaacggccaatttcccggcatgagacaaacggaaaaacatcaataatcttctttatttccttttcaacagctgaatcatcatagattttctcttgctcaatccagctatcagaaagtttcagctgccgaggctgtaaaaagcgctttatgtcctgaatggtttgaagctctttgccgctatgctcctctatcacataaccagggcaatacaattgatgtttttgtgcggagcgatttgcacttttaagcaattcctcgtctatcttcagttctttcgccactctggccaaattgttcttgatctcaggtttcaccgtaataaacgccatcatcatcccccttttttgttactatatgacagcgtatttaaaaaaagaaagcctcccgctcactttgacgcgggagacattgtgattacgatgcctgatcaagcatttgtttttctttccgttttgatgaattgtccagccttttctggtcataaaatcgcaacaaatccccataaatgatttcatcagaaagtgttagctcctgttttgctttatcagcaaatgcttcacattgttttgtctcttctaatggttttcccgtctctttgtcataacacgcaccgtctgtataaacaacctgatctgtgataaagctcccgtcccggagcaccgtaaagtccagtttttcgtctgaaagcagatcgttgccgaattgaatttgatctttcgtatcaatccctaaaagattcattagcgtcggcctgatatcaatctgcccgcctactgtttcaatggtttgcggctttttatcagtaatacccggaatatgaatgaccagcggcactttttggagctgcacctcttcaaatggggttatttcttttcctaaaaactgccccatcgcttcattatggttttctgatataccataatggtcaccatataatacaataacagagttgtcgtataatccgtcttccttcagcttttcgataaaccgttttagcgcctcatcctgataacgcactgtcggaaaatatttatttagcgtctggctgcttgaatcatattcatcaatcaattgatcctcttcatcaagatcaaacgggaagtggttcgtcagtgtaatcagcctcgagtaaaacggctgaggcagatttttcatcagctctgaagactgctcaaaaaattctttatccttcagtccccagccgactgaattttcgtcagttacatcatatgagttaatatcaaaaaacgaatcatatccaaatgagccgtacattaaatcacgattccaaaagctcttattattagcgtggagcaccgctgaatagtatccgctgtttttcaaaatttcaggagcggccatatattgattgcccgcattcgtaaaaaacacggcacctcgtccaagcggatacagtgaattgtccacgataaattcagaatccgaggttttcccctggcctgtttggtggtaaacattattaaagttgtagctctgttttataaagtcattcagaaaaggcgtgatttcttctccattcaatttttcattaatcacgaagctttgcgtcgactctaaggatacgagaatgacgttccttccttttgcagcgccgaataagcgtttgttggcatccttcgcattagcggttacatagttttcaatctccgtcaggctgttgctgtctgccaacgctctctgtgcggattgctttgactgaagaacgccatcgtaaatatgaaaattaaacaggctaatgtttttaacaagcatttctctgtcaaatgagcgtgtcaatagctgaggtctttccgcctcagacaagcccaggttgaagaaataaacagaagcaacgaacaaaaaataagccgcccgttcatttttcgttgagggaatgtccgattgaaaagctttttgccggatgtgaagccatattaaaaccgcaatatctacagctaataggaggtctgtcggctcaagaagtgttccgatgctgcttccgagatcacccatattgctcgtttgaaaaagaacagggattgttaagaaatcattgtaaaaacggtaaaaaaccatatttgccagcaatacaaacgtgacaagacagctcatcgcgataatatagcgatttctgtttttgccttttaaaaacaggctgaggccaaaaataagcaacaaaaaactcaatgggttgataaacagaataaattcctgtgttagattgtcgattttaatatgaaaactggttttgtaaacagcatacgttttcagtcacatcaaataaaatggcaatcagcataaatgaaattttcgaaaaaaacgtttttcgcatttcaacctcctatgcagcacgctcaaaaaatcagtctattcccaacattctcattaacacatcaaattaaatcttaacctgagcacaacaaaaaatcaatttgatttacacaattttaacaattttgatgtttcagccattcatttttagcgatccaagcgcctccgataacgccggcatcatttccaagtgctgcgattgaaatatcagcagcttgggcagcccgcggaaacgcgcatttgcggaatgttttctcaacttttgatctcagcagttctccggctctcgatacgccgccgccaagaacgattttggatggattaagcgagcttgccaaatttccgagcaccaaaccaaggtgcttggctacataatcaaccacctcaagggcaatttcatcattttcacccgccgcttcaaacacatcccgcgctgacaattgttcggttgcttgtaaacgtgtcgtctttttagcatttgctattttttcttttgcaattcttacaattccggttgctgacgcaattgtttcgatacagcccgttttgccgcagttgcagggcgctccgccttcagggatgctgcaaatatggccgatttctccgccggcgccatttatgccatgtacaatttcaccatttgcaatgatgccgccgccaactcctgtgccaagcgtcacgagaatgacgtcttttgcgccatcacccgctcccttccacatttccccgagcgcagcaatatttgcgtcattttctataacagctgggatgccggtttctgtctccagatggtttttcaaagcataatttttccaccctagatttactgtttcataaacaactcctgacgccatatctacagggcctggcgcacccattccgatgtatttgatgatgtgcttcggtttttgcagctcatccagcttgctgtcgatagtttttgcaattgtgacagtaatcgtgtcgccggttttatcagtcggaacttcccacttatgctgaatttcaccatattgattaataaaagcgagtttaatcgtcgttcctcccaggtcaatgcccgcaaaccatatctcgtccatttttatcaccttagcctttatagaaatctcttccgttttttgtttgttccaattcttttcgaaggacagctgccgctctggcccactgctccttttcaatcatgtggttcatatataattcctttaattcatccagcataaactcaatttcaagctctctgtctccaaaataaacaatgtggccaaacgtttttaacagctgttgcacatcataaaatgtattcattttcctcaccatttcttgaacttaactatcataagcgtattcataaggaagcggtcagtcaagaagaaaacgctgacaaaaaagccagcctcctttccatattccacctttatgattctttattgttttcaatttgttgctgcagctccttgtagcgctgctccttcggctccaattttaaagccagcctgatggccttttctgcttgtgcaagctcatttttttccgcatacaataaggctaaattgtaataggaagcatggtctttaggttcttttttcactgctcgttccaaaagggaaaccgcctgatcatattcgccgatttgaatatcagatacagcaagaaatttcaaaagatcggcagaggcatctttttgcgctgcttctccgttcagcaattctgttacttcttcatactttccttcctgatacagctcgtttgcctgctgaatcagcgctgactgctggtgtgaaggcgaatgcaatccgtaatataaaaaaccggcagcaaaagcaatcagcaaaaccgctgacaacaatctttttccaaaggctctggctttgggcaaccccaatgccgctgcagcgaaaaagccgccaatcaagccgccgatatgtcctgaattatcaatattcgaaactgcaaaaccaaagcccagattgatgataataatgacaataatattggttcctatggttcttaaaaacatttttcgattagacaaagcaacatacagtaatgcacctaagcatccgaatatggctcctgatgcgcctgccgaaggatacgggctgaacacaaagctcgcaatcgaacccgtaatgccagcagccagataaatcagcaaaaaccggcccgatccatacatccgctcaaccgctgtaccaaccgaccataaagcgagcgtattaaaagctaaatgcgctatgccgatgtgaagcacgatcggtgtcagaagccgccaccattctccttgtgcaatcaggctgttttcctttgctccaaaagcgaccagcgtctccgtattagtgctgcctccgtttatttcgagcaagaaaaacattaggatctgaagcgcaataaataaatatgtaaaaatcggttttccattttgaaaaaccgccgcttcagtttttctctgttcttcttgtttcagcactagcgaaaggaagcgttctcgcgccatttgcgcgttttcaaacgaagcgtgttcctctgtaccatcttctgtacgaaatgatggaaaaaccgcttgaagatcatctcgaagcatcgttcctctaacgatcgccggctcaactgacacagttcccttctcaaacgttttttttgcaatctcttcccagtcatcaacaggggcttccgttgaaaaaaacacattcagcagcttcatccttcgtctgcccaattgatgcctgactcgttctactcgttcggcctgctcttcgatgtctctaaccatttcttgacggaaatcaagatcgtgcttataaagacgaactagatcatgagaggacttgtccggcgcttccagccatatctcatctgactcaccggcttgtatgacgccatacccgctattcaccaggtgcgccgcaattttccaatatgtatactccagcaaaaacatgtttaccgctccaatagttttttttcattataacagctggcgctcccaaacgcctactgaaagcaaaaaatcccgtttttcacgggattttagaaagcttgctgtataaacttattgcggataaatggaattcttaaaaacaaatggataaaagaccgcctgattcctggctggctgagtacagtattcataagacggtagcgattttgataaaacatgacggcagaaaccgcgaaaatggcataaatcaaaagttttttcatgatatccctcctgccaatagggtttgttattctgccttatttattctcgaataagggacaggaaagttatgaaaaacaagaaataatccgatcctctgttatcagcttatgtaccgggatgtcatgtggcagactgggtacgtgcgcaaacagctggcactccaaaagcaaagagactgtcttcccttcatatgcacttaaatagcgatcataatagccgcctccaaagccgaccctaaacccgttaacatcaaaacaaacacctggaacgatcaccaagtcaatttgtgatgggtttacttcttttgttttttcaattaccggctcgagcagtccggcgtaaacggtttcgagctgatcatcggtcttatatgtccgaaattgcattttcttcgtgtccggatggcattttgggatgcaaacttgtttcccttcttcccaagcctgctcaatgacaggacgcgtcggtatctctaatcctctggagatggtgaccgcaatggtgccggcattttgccactccggcagagaaaacaagtacttatacatacgttccgttttttgaagcagatcttcatttgataaagcagacagtgcctccagcgtcttttttcttaattgtgatttcatctctcatcccccctcggaatagaaaaaaagccagaacctttttcaaagctctggcttttttcttacacctcaaacagcaaagctgttattttgtttcacggtgtaacgtagattttttatcacgtgggcaatattttttaaattcaacgcggtctggattgttgcgtttgttctttttagaaatatagttacgctcaccacattcagtgcaagccaaagtaatattaacgcgcattattttccctccaaactaaaatcatttacttattcagacttatatataataccactataatggacggaatgctaggctgtttttcaatgaattgctgaattattgaagatacgctcataaagctgcaaatatgatgacataatgagtcgggggtggtggagcttgaacacttgttgtctgccagcttcttttatccggcgggctttctcccggtcttttaaaaagctgtccagcagatcagccgcttcctgtacgagcgtaaaatcagcgatgattgccgttttgtcatgaacggcataatcacaaaaaccacccgactgagaaacgacagtcagcacaccttgttccatgctttcttgcgcggctagcccaaacggttcataagaactagggaaaacagccatttcacattgagacagtaacgttctgatgtctttcctattgagaaacggcaggaacatgacacgatccttcaggttatatgccgcagccaatttctcataggaggacagagacggcccctccccagccagcactagatagaggtcaggctgacgctgcttcaagatggcaaatacctttaacagctgcgaaaatcctttttccggaacgaaccttccatatgaaaagaggaatcttctatttatgcttctttggattttccccttctcttcctccatagatgcagggcttgggataacggttatttttttatgtgctgccttattaagagaccgcttcataaacgtgcttaatacgaccaaagcatcagccgattctataaggagccgttcggtcatgagcctgtatgggtgtggggcttctcggcacaccttcttcctttcgctttccaggccgtggattgtcgcagcaagcggaaggccaagccgttgtttcaaatactgggcggcaggggctgttgtgtcatcatgagcatgaatcagatcaaagcgttcattgtgtgataacacatggcgaaccattgtaaagttagcatcagctatgtaatcttcaaacttcgcatacgaaaacaactgcccgctcggagtacaaaccgtaatgttgatatgaggctttaaataggaaatgaggcggtttaaatggtcaccgagcccgcttttcggctcatcgggatgttcgggtgaaagcatgagaatgttcaccgttctttttcccctctcccataacaggtgtatgcagaaaattgctcttcccacctggtgtgcgcttcttcaatctgaaagctgtttatatgacgaatcccattttcatcaagatagatgtcatctgtaccggcaagcttgagagagacattcattgaattcacaattctgtattcagcccgatatacagcatcaccagccgcctgtctaatcgtccattcgcctttatcatacgttgtgcgttttgtcctgacagcttcaatgtcttttcttttgatgacaatgcgcaattcttttatcatatcctgcgttttttcgaaaaggaccgcttcagccagccgcattgtttcttctgagatttcccagcttacggtcaaggtgtgggcgttttgaatgattatgtcgaatgtgtccctaaaaaaggaaagcttatgtcgtatattatagggaaatgggtgtttatccatggactcctaacattctcctttccaatcgttcacttcgtgttcctattaaaccattacatatagaagaagcaaagaaagatttctcgacaaaatctcgtttttttcgcgaattcctttagaaactattggttttatggtataaaaaagaaggataaaaaaagaatagaaggtgatgaaacgtggaaattgctattattgcgttgtttatcgtcagtatagcgctaattgcattctcatattctcaaagagacccgatgaaagatgtagaacaggagctcgaaacactgcagctttctgcgatgcaggaaatttacaagctcaaaaagaaaatgacagtgcttgaggaagaattactggaaacaaaccttgtcattcgcaaatcaaagcagaacgacatcaatcaaaaaatcgctaaacaaatactttctaaatataataacggtatgtcagctgaagcgattgctaaagctgagcatgtatcagtggaagacgtgaatacgattatcaaagataatgagaaggtgctcgtatgacaaaacggggcattcaggcatttgctggcggcatcattttagcgacagccgttcttgcagctgttttttatctgactgacgaagaccaggccgctgctgtaaaagataataaaacagtaaccgaacaagacgtgaacaattaccttgattctaaaaaaatggtttctgtgaaccgtgatgaatatcaaaaacttcttgattcaaaagagaaatcgttgaccgatgacagcagctcagacacgaaaacagacaaagtcaaaacgtacaagctcaaaattaaagatggcatgagcactgcggatgtatctgctattcttgaaaaagagggcattatctcttcggctcaagactttaatgactatgtcattgatgccggctatcacaaagaaattcgtgccggcgagtttaaagtaaaatcagacatgagtttcaaaaagatcgtaaaaacgttaacacgataaaaaaacaggctgactcagcctgtttttttcatccaaactttcctgaaatgtaatcgagcgttctttggtccttcgggttagagaacattttattcgtattgtcgcattcaacaagctcgcccatgtagaaaaaggcggtttgatcagaaacccttgctgcctgctgcatgttatgcgtgacaatgacaattgtgtatttatttttcagctctagaatgagttcttcaatttttctcgttgagattggatctagtgcagatgtcggttcatccatcagcaaaatatcaggattggtcgcaagtactctggcgatgcaaagacgctgctgctggccccctgacagcgatagcgcggacgtatgcaatcgatccttcacctcatcccataacgccacgtcttttaatgacttttccacaatttcctgaagcttcttcttatttttggtgccgtggactctcggtccgtaagccacattatcaaaaatagattgcggaaacggattccctttttgaaataccatgccgatattttttcgcaaatccacgatgtccactttatcctttaaaatgttgctgccattatagttcagctcacctgcaagctttacattcggcgtcatttgaatcattaaattcaatgtcttgataaaggtcgatttcccgcatccggatggcccgataatcgccgtaatctcattttcataaatgctcaaattgatattttttaaagcatgatgctgtccataccataagttcattccattgacttgatagacttcttgtttcattacagcttcggtagcaatactcattgccgccctcctatccgaatttcccgttaatataatcctctgtcttttgctttttcggactcgtgaaaatctgttcggtctgtccgtattctacaagctcgccgtttaaaaagaatgccgtccggtcagaaacccgcagagcctgctgcatattgtgcgtgacaataataattgagtattctcttttcaatcctgtaattaattcctctatttttgcatttgaaatcggatcaagcgctgaagctggttcatcaagcagaagaacagctggcttcatcgcaagcgttctcgcgatgcataaacgctgctgctggccaccggataacgagagtgcggatgaatgtaaacgatccttcacctcatcccagagagccgcttttgttaaactttcttccacaatttcatctaaaacagctttattccgctctccggcatatttcaatgcatgtgtgatattcgcatagatcgatttcggaaatggatttggtttttggaaaaccattccgatttctcttctcaagctgacaacgttaatattgccgcccaatatatttaatccctcataaaggatttcaccttccgctcttgcagatggaattaaatcgttcattcggttaatatttctcaaaaaagtagattttccgcatcccgacggcccaattaaagcagtcaccgcatttttttcaatatccatgtttacatgatgaacggcttgtttatttccgtaaaaaatagacagatctttgacctcaagcacgtgattctgcttcggaacaataacagctcgctcaggtttttcttttaccatttgttcagacatgtttttcgcctctttccgttctaatttgccgtaagctttttgtagatcatcgtgccaagccatctcgccgcgagattaaacacaagaacagaaatcaccagcacggcagaaccaccgttggcaatcgcttcagcatccggaatcattccttgtgtattgacgttccaaatgtggaccgcaagtgtttcagcgggcctgaaaatattaagcggtgatgtttccgaaaacgggttccactccgtaaaattaagacgcggtgttgtcaggcctgccgtaaataataatgcggccgcttccccgaacacccttcctgacgctaaaattgctcctgtgataatagaaggaatcgcacttggaattaaaaccgtttttacggtatgccagcgtgatacacctaaagcgagagaggcttccttcagatctttagggactgaacggatcgcgtcttctgtcacacgcaccatgacaggaaggttaaaaacagttaacgcaagcgccccgcctatgatcgtatatccccagcctgttaagttgacaaacatcaataatccaaacatcccaatgacaatagacggaagagatgaaagcacctctatacatgttctgatgaagtcagttactttgttattaggcgcgtattcagccatgaagactccgccgcccacaccgagcgggattgtaatcagcattgtaataaacaaaatataaaaggagttaaacagctgatctcgtatgcctcctccagctgcaatggcgctcgattttgttgtaataaattgaaaactgagctgagaaacaccgtttataataatataggaaaacaaacctactaaaatggcagcgataatggctgcacacaaaccaaacattccggtcgccagtttatctgttattttgcggttcattacactttcctcctagatgacaagtagcgaataagcaggatgaacaagaatgacatcaccagaagcacaagccccattgaccacagcgtattgttttcaacacttccgtatgtggtgtggcccatattcagcgtgatgatcgttgtcagcgttcccgcagtgtcaaacaggctttccggcaatactcttgtatttccaatgaccatctgaacagccaaagcttcaccgaacgcccgagccatgcctaacacaacagctgtcatcaatgttggaaaagctgcaggcacaagtacttttctgatcgtctgccatcttgtggcaccaagcgcgtaagaaccctctcgtaaactcttcggaagagaagccattgcatcagcagaaatcgatgtgatcgtcgggagaatcatgacggaaaggacaatcgttcccgccaataaactgtgccctgttccgctcgatttgaaatgggcgataaacggcaccaatactgtaagacctatgaatccataaacaacagatggaataccgactaaaagctcaatcaccggctgcagcactttctttccccaattcggggcaatctctgtcataaaaatcgcacctgcaatgccaagcggcgcagcgattagagcagaaagaatcgttactgcaaatgagccaaaaataaatggcagcactccgtatttcggatcactatctgtaggattccaatttaagctcgttaagaattcaattgggcttacaccatttacaagaaaagattgcagccccttcacgccgaggaaaatggtgattgcaacagatgccgcaatcataatcagtgcacaagctgtgactatcattcttccccgaacttcatccaattgccgattttgcctagagctgattaagcgctcgctcacagacatattttctctattgtttatcattgttttacactcctatgaatgtgttaagaggagaaacggttgtccccgcactcctctttttattaagatcagctttgcttcccgttggcatcacgtgtcactttcatatcagtaactggaatgtagccttggtcagtaacaatgcttttttgaatgtcttcactctttagataatcaagaaattctttagctaaacctgtcgcttcaccttttgtataagaatgctgataagcccagatcggatactcgccagttgtgacatttttcgcttcaggttttacaccatcaattgatagagcagttactttgtcatctgttaaatatgagaatgcaagatatccaatcgctcccggagtatcagcaatgatttttttcaccgtgttggaggaatcttcagtaatgccttctgcaggttcttctccgtcaagcgcatattttacaaatgtagcacgtgtgccggaagaatcaggacggtttacaagtgtaatcttttggtctttgccgccgagctctttccagtttttaattttgccagtgaagatttttttcaattcatcttttgaaatatcctccacaccagcatcagggtttacagctgctgccataccaactacagcgacttgatgatcgacaagcgcttttgcattgatgccttctttttcttctgcaaaaacgtctgaattcccgatctgaacagctccttcagagacttgagaaagccctgttccagaaccgccagcttgtacctgtatatcagcatcagggttttcttccataaatttttccgcggctgcaagtactagtggctgcattgccgatgaaccagaaatggttaaagaacctgatgccttttcttctccttttgcagaatcgctattcgattttttactttctcctgcatttccgcatgcagctgcaatcatcataaatgcagccatcagaagcataagcaccaatttgttttttttcatttcctgaattccccctgcgtataatgtgtaatttgtcctacacgtatagagtaaaggttctatgtaaaaagggtttgaaccgaatgttaaggttttgtaaatcagtgcgtttttttgtataaaaaaaaaacgcccacatcatgtgagcgtttctttttagttatcagaagacgttgtgttttctgcattttcttcaattttgtctttattcttttgctgagtatcttctttgtcctgcttcgatttcagctcaaaatatttatccattacttccctgccgatttcgtttgtaattgagtatctttgattgtaatcaatgtaagtccaaggaactacgacagaaatagcaatctcaggattgtcagctggtgcataagccacaagcgtcgtattataagtgtctgttcctgtttttgatttatccggtccgtcgtaaaatgattgggctgttcctgtttttgcagctggtttatacgatgctgaagccagttgacctgcagctgtccctttagtggcaacccgtctaaaaccggcttggacctcttcaatatagctactcttcatatcgactttattcaatacttcaggctgaacagaatcaacgactgcgccgatcccttttttcgcatttgaatctctgacttcctttacaagctgaggcttcatgcggtagccaccatttgctatggtggagacatattgagccaattccagcggtgtataagtatcatactgtccaatggcgaaatcaagcaagaaaccagataatctgcttgtacctttatatcccgtcatttcatttggtagatcaattcctgtttttactcctaatccaaattgactgaaataatttctgaaggtatcaaatgcagaagtatccaaaggcaatgcttggtgaggtttatattcacctttaccaactgcaatagctgttttaaacataaaaacgtttgatgacttctctaatgcagtttgaataccaaccggccctaagttttgccaagattttttccctcttttatcctggccgatatacaatggttcatccttaaatacagtattcaaattaatcgctccagtttgaagaccggtcaaaacggttgcaccttttacagctgatcccatagcgtaggatgaagtcatggctcctaatgcataatcatcaaacttataggctccattttctcgtttaatctgcttccctgccattgtcagcacttcgccgtttctagggtccatcatgacaacgaatgcacgatccaacaattcggtactaggtcttgctttagcagctttaagttttttctcaataattttttccactgatttttgcaaatcaatatcaattgttagtacaagatctttcccggctttgccttcagataccgtttttgttcccgtgacattgccttttgaatctgtgatattttcgacttttgctttttggccctgcagaaggctttcatattggtattccaaatagctttttccgaccctgtcattacggctgtagccaagcgacagataatggtcgagcaagttggacggcaatccttcattagagctggaaacacttccgagcactgagcgaagaaggtttttataaggatattcacgttcccaatcggacgtgacatcaacacctggcagttcgtctaaatgttcacttaccactgccatttccttcgctgatacatcttcgtttttgatatattgaggggtcaatgcatagcccgaatccatctgtcttttgatagcaaggatctgcatatctttatccgtcaattcattcagctgcttatcagtaatccgttttagctgaagctggtataaatcgtcatcggatatttttttgtcttcaacctgctgtctttctttagagctaatgagctttttcgcttctttcggtctagtcaaaatccaataatcttttttatcccgttctgttactttttttgtatcgactttgatcatgtcagacagcttttttgcgatctttaagcgctgttcttgcgtggtcgatttagatctcgtgtatgtgattgcatttaaagccttatttgtcacaatggcattaaagtttcgatcataaattttcccgcgtggtaccgctgagctgacttcactttgttcctgcttattcgcttggtttttgtaatcatcaccttgcacgatctgcttgatgcccagttccacaataatccaggtaaatataacaaaggcagctaaaaataaaatattcagccggatcggaagcgacttctttttctctttatgattttgcttttttggtttatttctcctcataacatcaccttttctatttacagaaagaaaagacactcaagtaagagtgccagttttcattttaaaggttttttcgacttttttctacagataacccctttttggcaaaaaaattatctctcgccttttaaaagggtcggttctgttacccgtttttggccgtcttcttccatggtttcattttccccttctttctccttaaaacgaatatccttgacaaagtaataaatcaaaggatgtcctatacccaatatcgcaagtgacaaaggaattcccacatcctctttcagaagggccacaatcaggagaaagcacaaaatggaaacaattctgccggcgttcaagaacatttctctaagcacgatatattcaattcttgcttttctggcatgcctcgcgcgccctatcacatcatatgtaagtgatacatatggcacaagcaacagaggatagccgatggcaataaaaacgccgtacgttaataatgtcgaaaagctcatatggaacagaatcaaaaacagcgcgccatacaaaataagtccgcccagcaaaatcgatttttttctcgcctttttcttaatcagcctggatgcaaagtagtaggcaaagaaggaaacagctgaattgacaagaccgaatgtaccgagagcaagctcgctgtttgtctcaataaatacaaacacactgattaaaaagacaaaaatcccttctctcaaaccctgaaaaaaatgcgcattcgtgattctccgccaattcatattgctatggcgctctccaaatactttgctcagcataaaacggccctttgattctctccgttttaagaaaaagctcatcacgacagccagggcaaataaactgagggagagactgaaaatcactgtataacccgtattattttcaagccttgagatcacgaatccggctacaatcgggccgatcattcctgcagaggaagacagaatgcccataaacccgttgaaaaagtctcgtgtatccggctctgttatttcaaaggtcagcacgttaaacgctagccaataaaagccatagccaactccgagcaccgcgccgattagcacgaggcggctggccgccgtttctccggctaaaagcacacttaaataaaaggcagctaaaaaaatgacgccgaaccttaaaatgaataccctgtctatttttttggctaaccgtccagccaaataaaaggttatcggctgcattgtcacaatggataaattatatatcgccaaatcaataaatttccctgactgcttccaaagatacacattaacaaatgtattggacagtgcaattcccagcgagtaaagcccgccaatggtcagcagaaagagtaaccctttgtttacgtctacatcgcctatcactttttttagtttgctcattactgactcccctttactatcccttagtctgtctcactcaaaccgagatatgtaaaaagaagacataaaaaaacaaggtcccataatgaggaccttgtttgtgccattattttgcttcgctgtatagacgagccacttcgtcccagtttacaacattccagaaagctgaaatgtaatcaggacggcggttttgatagttaaggtagtaagcatgctcccaaacgtcaagacctaagataggcgttttgccttctgaaagcggagaatcttggtttggcgtgcttgtgatttcaagtttaccgttgttcacaacaagccatgcccagccagaaccgaagcgtccagctgctgctgctgcgaattgctctttgaatttgtcaaagcttccaaatacactgttaatctcttcagcaagcgcgccagtcggttcgcctccgccgtttggagataaaagtgtccagaataatttgtggttcgcgtgtccgccgccgttgttgcggactgcagtgcggatgttttcaggaacagaatcaagatctgcaacaagctcttcaactgatttgttggcaagagcagtgtttccttcaaccgctttgtttaaatttgtcacgtatgtgttgtggtgtttcgtatggtgaatagtcatagtttccttgtcgatatgcggttctaaagcatcgtacgcataaggtaattctggaagttcgtaagccatgataattcctccttagtatatatgtactgaaatgccgcttcacagcgagcctttcttcattcaatgtaacaaaagaatgctttgtaatcaatgaaaaagctcacgatttggctcatttcagcggacatatttcactttaaccgataatctgccccattaaacctgccgccagcatttcttataggaccgtccataaaaagtatccgatcatcaaaagctgtatgatgcccttggcaataacccctgttaaaaaaccaatgagtgagccgaggccaattttaaacgctgactttaagtccttctgatggacgataagttctgcgcaaacagccccgataaacggacccaatatgatccctgcaaccggaatgacaaaaggcccgattaataaaccgatcgtgcttccccatatggcagctttgcttcctccgaacctttttactccaagcagattcgacacgtaatctgctgcgaataatactgcggcaaaaactgcctcaacaagccagaacatataagaatacggactgaatgaaaataaaaatccgtacaatacaaatccggcaacaataaatactacgcttggaataacaggatacaccagcccgataaaggcaatgataaaaaccgctgcaattaacagccaatacaacatatccatagcttccatcctcccattttactctgtcttcttcatgtcttccttgtattcacacgcatgcaacgatacaataagcaacatatattagtttagctaggaagtgaagatagtgaatgtgtttcagcttttcattaaaagtacatactctccccgtgatattgcaaaaacaagatttcaaggaatcggaaaagcgattctttatgtatttttgctctctgtcctgtttgcaatccctaccgcttattatgtaagtacagggaccgtaaaatcaatgaacggctttaaaactgttttaaacaaagatttccctgatttcacaatttcaaacggcaaacttcaaacgaatgagaaaaaagccacggaatctcaagcaaatggtttcgttatcgtgttcgatccgacagactcctatggcactgaacaaattgaagcaaagcaaaacgcgatcggcatccttcagaacaaatttgttttggccattgacggacaggcccaagaaatgtcttactcaatgatgccgtcagagttacagaaaaaagatgtcattgcagggttaaaccaaaataaagcgatgattgtaactgttctctcagctcttatttttctcgtaacagcagcgggaaaatttattgaagtatcgtttttagcgcttatcgggttaatcattaagaattcgcagaaaaaacatttatcctatcatcagctctggaagctttctgcttattccatcaccctttcaactgtattctttacaatcatgcgggcattagaagcaaccgtaccaagtgaatttttgctgaactggtttgtcaattttgtcatcctgtttctcgttttaaaagagattccgtccaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagagattccgtccaaaaaagctgctgtataaaccgaggctgcattcgcagtctcttttcttttgtcatgaatcgaaatggacaagcatactatgatataaaatttcgtatgcgggaggaaaagcgatgaagcgtctcaccttagtatgcagcattgtttttatactttttattcttttttatgaccttaaaattggaaccatacccattcaggacctccctgtctatgaagcatcagcaaaaacggctgcacaagaaccggcttataaaacggtgaaggtaaaaccgggtgatacggttatgtcgatagtcggatcagcaggttctccggatgacattgtaaaggattttgaagcactgaatccaaatgtgaaagccaatgccattcaagcgggaacagcgtataaattcccggtctacccttaatttaacgttaatttcttgtcagttcggcgaagacactgttacaatgtaatttgtaaaataaattcacataaaccatactagaattgttatatctagaagcggcaactacaattaaggagcgattgcaagtgagtgaaatcacacatcgtacaaaaacgcgtcccgtcaaagtgggacctttaacaataggcggcaacaatgaagttgtcatccaaagcatgacaacaacgaaaacacatgatgtagaagcaacggttgcggaaattaaccgtttggctgaagccggatgccaaatcgttcgggtagcatgtccggatgaacgggcagcaaacgccattgcggatattaaaaagcgcatttccattcctctcgttgttgacatacatttcgattataaacttgcgttgaaagccattgaaggcggcgcagataaaatccgaatcaaccccggcaacatcggccggcgcgaaaaagttgaagcggttgttaaagcggccaaagacaaaggcattccgatcagaatcggagtaaacgccggttcattggaaaaacgcattttagaaaaatacggttatccgactgccgatggaatggtagaaagcgcacttcatcacattaaaattcttgaggatcttgattttcacgatattattgtcagcatgaaggcctctgacgtgaaccttgcaatcgaggcttatgaaaaagcggcgaaagcgtttgactacccgcttcacctcgggatcaccgagtcaggaacactgtttgccggcacagtaaagagcgcagcaggactcggcgccattttaagcaaaggcatcgggaacaccatgcgcatttcactaagcgcagaccctgtagaagaggtaaaagtagcaagggagcttctgaaatctttcggcttagcctccaatgctgccacgctcatctcatgcccgacttgcggccgtattgaaattgatctaatcagcattgccaatgaagtggaagagtatatttctaagataaaagcgccgattaaagttgctgttctcggctgcgctgtaaacggacctggtgaagcgagagaagctgatatcggaatcgccggcgcacgcggtgaaggactgctgttccggaaagggaaaattgtccgtaaggttccagaggaaacgatggtagaagaactcaaaaaagaaattgacattcttgctgaggaacactacgcaaaacttgaagctgaaaaagcaaaattaaaagaagaaacacaaaaagcttgacgggaacccgtcaagcttttttgtgttagaaaaatggaataataaatattccaagcactaatgaaacgacaccgatacccattgcccaggcgccaaggccttgagcacctcttcttcttgcgatatagccgacaataataccggcagctcccaataaaacaggcagtacaaacaatgaaataatagacaaggctaaagcgatatatcctattccccgtccttcattgacattgccgccgctgcgatcattgtcttggtcattgctgcggtcagcagcacgataaggctctgcgatttcagcagctgtttcctcaaaaaaaccgtcattgtcacgggtaatatttgtcccttcagatccatgatcaacatagtaactgttgttatcacgcttttcgtaatcgtttgccaccttcaattcccccttctgttttattaaaggagcttttatagtttgatccattttgcctgattcatgtttgctaaacttttctgttaatgtcaattgtttatgttacacttgaagggatgaaactgaaggagtgtgggcatgttacgcttaggaatagatattgacggcacaatcacggctcaggatacattcgtcccttatttgaaccgttcgtttaatctttccatttcattaaacgatatgacggattatgatttaacaaagctgttaaacattacccaggaagaattttgggattggatgaatcaaaatgaagcgatcatatataaggaagcattgcttgcacagcatgcgaaacagtcacttgatcttctcaaagaggagcacaagcttatttatattacagcgagacggactcatttaactgatattacctatgaatggtttgacagacaaaacattcattatgaccacatcgaactcgttggcggtcatcacaaagttgaagcggtcaagaatcataacatcgacctgttttttgaggatcatcacggtaacgccatgatgattgcgaaagaagccgggataccggtgattttgttcaattccccttataatcagcttccgattgattcaaacatcatcagagtaaacaactggctagaagccgttcaatggatgaacaacaacaagcagcacttaatacgcgtcaataactgaaaaaggagcccaaaccgggcccctttttcatatatacgcattttacccagtagtgttgtcttggttttccgctgtacaatcagggcatgtgccgtaaatctcaaatttatgtccgctgacctgatagccatccaaatcatcacaaagcttgtccatcggacatgattcaatttcctttgttttgccgcaggcaagacaaataaaatgatggtggtgatgggtgaatgaacacttaaatcggaagagcttttcaccggacagctcagttgtttccaaaatcccaagttcttcatataaagaaagatttctgtagattgtatcaaagcttaagcctggataatcatcattcagtgcagacagtacgtttttagcggtaagatatctgtctgaatcagcaaaaagctgcagcatatcctcccgtttgtttgtatatttatatccgttttcttttagtaggttcagcgcttcttgtacgttcatgaagggtcccccttttcgctttgcttaagaacgtattacatgtatgaaaaagaaaatggcagctgtctgtccagcaagccattttctttactgcagataaaattatacccataaaatgaataaaagtaaatgaaagcctagtggattgcgtttttgaattttccgcctctcgtttcatgagtattcataattgttatgaatgcattttgatcaacttcaaacacgatcgatttgagctttgtcacttccagccttgtgacaaccgcgtaaattacgtctttttcttcgtccgtatatccgcctttccccttcagcttcgttgtgccccgaccgagacggtgcaaaatcgcgtcggaaatctcatcatactgctcagacacaataatgacagcttttgtttcatcaagcccttggatcacggcatcaatcgttttcatcgcaatataataagtcatgaatgagtacatcgcttgctcaggaccgaacacaaaaactgcccaaatgaaaatgaacacattgatgaacataacgaactcacctacagaaaacgggagttttttggtcagcaaaataccgagaatttctgtaccatccattgaacctccatttcgaataacaagcccgacgccaaagccgagtaaaagacctccgaacacagtagccaaaataggctgggttgtaatggcttctacatggtgaagtgaggattcaataacggcaagcccgacaatccctataaacgtagagactagaaaggtcttaccgatatatttatatccgaagatcataaaaggaatatttaatatgacaacgaaaaaagcgaaattcagaaaggggtttgacataaagaggtggtctaaaataagagatacaccgataatcccgccatcaataaaatcattggggattaaaaataattcaatacttacagccgcagatgcagctcctaccagaatcataaagaccctgaaaataaaatgggtaaatgtttctttcttatgttgttttgttggggtcataaaatctcctttcctgcaataactattttaaatacattataaatctattttaccattaaacactgacacattttactgatttgcccatacattaagtctggaggtggaatgaccgatgattttatttcaaagaattattttgcagcggcttaatcaggctactgctgatgatttgctgaagtactcaaaacaatacggaatcagcttaacaagatcgcaggccgttgaagtagcgaacctgttatacgggaaaaatgtaaacatctttaatgagagtgaacgaatgcggctgctgaaacaagtagagacgattacatcgaaagaaacagctcaaacagttaatgaactattcaaacaatttacaagctaaaaaatgggggtgttatcccccattttttattgctgtaaaatcttttcaagcaatgtatcatcaaattgtttttctttcagcatttcaatctcaaaacggtatggcggttttttgttctttttatcttcaccgacgtatggtgtttcaagaatttttggaatgtcttttaactgctcatggtgaacaacatattgcagtgcgtcaaaacctatttcaccaaagccaatattttcatggcggtcttttctcgcacctttgacatttttgctgtcattgatatgaagcactttaatacggtcaatgccaatgattttatcgaactcatttagcactccgtcaaagtcttcgacaatgttatacccggcatcatgtgtatggcacgtgtcaaagcacactgacagctgctcattgtgtgtaacgccttcgataatctgcgcaagctcctcaaagcttctgccgcattctgatccttttccagccattgtttctaatgcaatctggacattttgattcggatcaatcacttcatttaagccttcaataatttttttgatgccggcttcagctcctgcccctacgtgagcgccaggatgaaggacaatttgcttcgctccgatggccgctgtccgttcaatttctgaacgaagaaaatcaacacccagctcaaaagtggacggatttgtcgtgttgccaatattaataatataaggcgcgtgtacgataatctcgtcaatgccgttttcttgcatatgtgcccggcctgcttctatatttaagtcttcaattttctttcggcgcgtattttgcggtgcgcctgtatagatcataaacgtattcgccccataagagactgcttcctggcttgcagccagaagcatatgttttccgctcatagagacgtgtgagcctattctcagcaacaggttcccctactttcttttcttagattggtttcttctctgttttttcttgattttctccatctcatagctcattttctttttatacccaggcttaaccttcttcggctttttcacgagacgatgagcaatttcatccgcttcattcggcgtttttttacgttttttgcggcgctgacggtcatcgccttttttccattcgcccttttcaagctctaagtactcaaattcgatgcccattttttcaagtcttactaatgcatcctcatcagtaagctcataaatggtcatcgcttgtcctgatgagccggcacgagccgttctgcccacacggtgaacatagaaatcgagatcatccggcagctcatagttgataacatggctgacacctttaatatcaatacctcttgcggcaaggtcagttgcaatgatatatgtgaattccaaatcattgatctgcttcatgacttttttccgctcacgtggtgttaatccgccgtgcagcaagccgattttcatgcctttgccagtcagatactgggcaatatggtcagccgtatttttcgtgttggcaaacacaatccccaggtatggattcagatgcgacatgatgtcaaaaaggagcttgtccttgtcacgatgtttcgaaggaatgaggatatgctcgattttcgcagcagtcacctgtttgggctccacatgggcatatttcggattttccatgtatttcttcaagaatggtttcagcttttccggtatggtcgctgagaacacaagcatttgcagatcctcaggcatgcgggaaccgatgtaatctacatctgcaaggaatcccatgtccagcattagatccgcttcatcaataacaagagattccgctttatgaacacttaacgcctgttctttgattaagtcagcaatccgtccgggtgtaccgacaacaagatgcggctgtattttcaatttatcaattgatttttgtttatcagtgcctccgataaaacatttcgagcgaatctgactgccttcctcaccctgcgtgattttaagcgcttcctgataaatctggttggctagctctcttgtcggagccgtaatgactacctgaacgacatccttagcaggatcgattttgtttaataaaggcagtaaataagcgtgagtctttccagtacccgtctgagactggccgatgacgctttctttttttaacactgcaggaatcagccttttctggatatcagtcggttcgtaaaaaccaaggcgatgtactgcatctataataaatggtttcaattcataaagttcaaatttcgtttctttcatttttcccagctccttaaagcggcacattatgtgtccatcatcacattatacccgattttgcttaaaaacaccacgtttgcaaggcgtttgttttattcagttatgtaaagcaaataccgcagcccatgcatattctaatagcagagagagctgaaaggaggtacaagtatgttttcaccgcagcagccaatgagaaattacccacagcccggaccgccccgccccatgccaaatcagcgaatgatgggcagaagaccgcctaatatgcgaggaccttcatttggagcacagcagcaaggttttcagcaagccggacaatttcttcctcaggcaaatgccggagcgagaaatggtgcaggtgcaggcggaggcttaaaaggaatgctgtcaagattcctacccggcggaggaggcgctggcagcgccggagttccaggagcaggtgccgcagcgagcggaggtgctggcctgcaaggcattcaaaatatcgccaatcctgcatcattatccagtatgcttggaaatgtgcaaaaagtactcggcatggcgcagcaagtcacccctatgatccagcagtacggcccattagtccgaaatctgccagcaatgatgaagctgtacagccaattaagtaaaagtgatgatactgaaacagaggccaatgaggaaagtgaaaaacaatccgtttcagaagaatcatcagaaaaagaaaaagagactgaaacaaaaacctcagatgggaacaaaaaatcaaaaccaaaaagttcttctctcccaaaaaaatctaaaacaactgacaataaagaacaagaatcaaaaacatctgccccgatgaaaaaggaagctgcctctcctgctccgaaaagaacatcaggcagttcaaaaccgagattatatatttaacattctttgatatctgaagtgagattggctataatgagatcagaagaatgcaagaatagagccgtttgattacggctttttatattgcctttactcacttcagtattggaggacaaccgaaaatggacgtaattaaaatttcaccgcgcggctattgctatggtgttgttgatgctatggtcattgccaaaaatgcgtcactagataaaagcttgccaagacccatctatatactcgggatgattgttcataataaacacgtcactgatgcgtttgaagaggaagggatttttacattggacggctctaaccgtctggacatcttaaagcaggttgacaaaggaactgtcattttcactgcgcacggtgtttctcccgaagtcagaagaatcgcagaagaaaaagggttagtcgcaattgatgctacatgtccggatgtgacgaaaactcataatctaatcttagagatgaaagaaaaaggatatcacgtaatctatatcggcaaaaaagggcatccagagcctgagggagccgttggcgtagcgccggagatcgttcacttagttgaaacagaagaagatgtaaagaaccttgatatccaagcagagaagttaatcgtgacgaatcaaacaacaatgtctcaatgggatgtccacgacattatggagcttgtcaaagaaaaatatcctcatgtcgaatatcaccaagagatttgcctcgctactcaagtgcggcaggaagctgtatcagagcaggcaaaaaaagcggacttaacaatcgttgtcggagacccgaaaagcaacaattcaaataggcttgctcaagtgtcagaggaaatagccgggacaaaagcataccggatcggcgacttaagcgaattgaagctcgaatggctgaaaggcgttaataccgttgcagttacagcgggagcttcaacaccgacgccgatcacaaaagaagtcattcgctttttagagcagtttgatcacgaagatccatcaacttggacaactgaacataatataccgctcaaaaaaatacttccaaaagtaaaagcaaaaaactgaggctgtaaaagcctcagtttttttatagaaatgtaaatggatttgtatctgtttcagaaacaaagatattcacgtcaaactttttatcattacacattgatgtcagctttctcgtgacgccttctttcatgattttttccgcatagtgtcccggatcaaccacatttaggccaagcatcatcgcatcatgggccacatggaagtataaatcccctgtgacgtaaacatcggctccctttcgttttgcatgatgaatatacttgtttccatctcccccaagaacagctacctttttcaccatgctgtcagcatcccccaccattctgacaccattgacgtcaagcttgtctttcacaaataaagcgaattccttaagcgtcatctcatttttaagggttccgacacggccgagccctttttcggcgggagtctgttcgacaggatagatatcgtaagcgacttcttcatatggatggctttttatcattgcgttgataacagccttttcgacgcttttaggaaatacagtctcaagccttacttcatgaacaagctcaagctctcccacttcaccgataaaaggcttagctccgtctaatggcttaaagctgccgattccttcagatgaaaacgcgcaatggctgtattcaccgatatggccggcccccgcatttccgaccgcggctctgacctgctcttcatattccttcggcacgtaaactgccagctttttcagaggatccgtataagtaggcgccagcacttccgtctcactcagctctaatgcttcagcaagcaaatcattcacgccgccgtccgcaacgtctaaatttgtatgagctgcataaacagcaatatcatgcttcaaacacttttcaattaaccttccggcaggctgatctgttgaaatatgctttagcggccggaaaataggaggatggtgtgcaataatcaagtcaacctctttttcaatcgcttcatcgataacgctctctaacacatcaagtgtaaccatcacatttttaattggtttgtttaaagtgccgatttgcaggccgattttatctccttcaaccgcatagggtttcggggaaaattgttcaaacagctggatgatctgctgcccatttacacttttagccatgatcgattacctcctttaacagctccattcgatcggcgagctcctttaatttttgtttgttttgctctgtatccgccgcttggctgatctgttcataaatgctttgagtgtgctgaagctcttgtgtccactttttcaaaaagacagcatttttttcttttgccaagaaagggccgacgagcatcccggctgataaagaaataccgtcataagccgcatccctgtctcccgcttctgccaccagcacctcatagcactttccgtcctcttcaaggattacctcatctatcagcgcatatctttctttataaagccactccctgatatgaacagcatgaatattcggctgtaaaataagccgttccttccccgttaatttgtctttgcccgcttctaaaatgtgagcgatcaaagatccgcccattccggcaatcgtaatggcatcagcttcaccttttttaatcacttccagtccgtctccctgccttacagaaatgtgcgagtttaagcctgatttttcaacctgccgctttgcagacaaaaatgggccgtctgttatttctccggcaatcgccccgctggctttatgattcagcaccgcataacaaggaaggtaggcgtggtcagagccgatatcggccatcaccgctccattcggtatgtactccgctactgtttgcaatcgtttagataattttaattcgttcacttgtcatcacaacttttctcaatcattttttcctttactatcatataaaaaatcagcccggaatccaagctgaagcaaatgattttgaaattatttcttttgatgcgggtctgcacgcggcagtcaaaaataaaaggctgtcgagaacatctcggcggcctgtgaatgtataaagagaaaaatagttcttttatttaatttttgacacccactctgccatatcatccagcttatcggcaggaacaagaccggaaggcattccattaccgcctttttcgatctttgttttaatttcagcgacatctttcttatcccctacaccttttaagctcggacccgaaacaccttcataattttcaccgtggcatgcgatgcagtttgccttgtaaatttcttctggtgaagcgtttgcatctttcttttcagcagatttgctttctcctccgcttgcaatctcccgagagtcatcaagtccttttactgataaaaagaaagttagaccaattcctaaaacagcgatcagcaaaaatggaataagcgggttccatttcatttcccttccccctttttgatccttccccctatgtaaacacttctaattctaacttatttttacaaaaagtaaatggattgctatacaaaagttttttattcacactttatacaaaattgaatagaaacatgcctaaatctctaatatcctttttattctattgtataatgtattgtatacgcttacaatagaaaatatggaattagattttgaaatttttcaccacaatgttcatttgcaaatgacatcatttttcagtaaaataaaggcatattatccatatatctttttaaaaaaagaagaacggatcttcaagacccgttccatcttattcaaggaaatctttcaaacgtttacttctgctaggatgtcttagtttccgcaacgctttggcttcgatttgtcgaatacgctctctcgttactccaaatactttgccgacctcttctaatgttcttgtacggccgtcatcaagaccgaatcgaagacgcaatacattttcttcacgatcagttaacgtatcaagcacatcttccagctgctctttcaatagctcgtatgcggcgtggtcagaaggtgaagttgcttcttggtcttcaatgaaatcaccaaggtgcgagtcatcctcttcaccgatcggtgtttccagagataccggctcttgagcaatctttaagatttcgcgtactttttcaggcgttaaatccatatcttccgcaatttcttcaggtgttggttctctgcctaagtcttgcagtaattgacgctgcacacggattaatttattaatggtttcaaccatatgaacgggaatccggatcgttctcgcctgatcggcaatggcgcgtgtaatcgcctgtctgatccaccacgtagcatacgtactgaatttataacctttgcgataatcaaatttttcaacggctttcatcagacccatgtttccttcctggatcagatcaaggaacagcataccgcgtccgacataccgttttgcgatactgacaacaagccgcaggttcgcttcagccaatctgcgtttagattcttcgtcaccttcttcaatcttttgagcgtaggcgatttcttcttttgcagaaagaaggttaacccgaccgatttcctttaaatacatacgaactgggtcattgattttaacgccaggcggtacacttaggtcattaaggtcaaattcttcttcggctttggcaagctgctgaatattaggatcttctgtttcttcattctcactaattaattcaacaccttgttcacctaaaaattcataatactcatccatttggtctgattcaatttcaaagctggacatacgctcagcaatttcttcatatgtcaaaacgccacgttttttaccagactctgttaattgctcttttacttggtcgaatgttaattctgtctcgtgggtttgtttatcagccattatggatccctccttccaaagcttgcaacgaattctataagcggtatgattcttattcggtccattcaggcgttttctatgtgaactgcctttaacaatgtgcgaataatgaaatgacaattcatgatgaggttaagcgatctatttgctcctccgcaaggaatcattgccaatacatgctcctcatcagttctccagttattttaaagatcggttcaatgtaacgatttcttgagccagagaagcagctcttaaaaaatctttttgcctttcggcttcggctctttccgcctctttttcttttatcattgaccaatttctttgattcaacactttttttacataatctgataactcggcttcgctaagctcttgattaacctgaagcattaatatatcagacaagagctggcttatatgatcatccgtcaccctggccatcagatgctgaggcgtcagctcggctccctcttcataaaaagcataaagataggcggctaatgcccggtgctcatcaatattaaattgaaaccctacccggtcaatcacttttttgatgacgctccgatctcgaagcatgtgagcgagtaacagcctttctgcattttcatacgccggacgcaaacgtttttgccttgcttttgttgtcagatgcgctcgccgcgtttttgtttcaccgctattgtcagcaggtttgttttgcttgctgaaaacagacagctgctcagttaaagactcctgtgaaagcgaaaactctgaagcaagctgctttacatagacttcctgctctagagaccctgaaagcgtgctgatttctttcagtacgtctttaatgtaagctagtcggtcgccttcatcggacaggttctttccttttcggaaatattgcattttgaacgccattacggtgacactggcgtcaataatgtcgtttttaaatttttccccgccgaattttttgatgtaatcatcagggtccaatccgtcaggaatcattgcaactctgactttgcagccttttttttgcagaagctccgaagcttttaaggtggcttcataaccggctttatcagagtcatagcaaagaatgatttcttcgacgtttcttctcaagatcttgacatgatcatctgtaagagacgttcccatcgtggctatgctttcttttacacccgagcttacggccgatatgacatcagcaaacccttcaaataagactgctctttcctgctttctgatatgaaggcgggccttataaaaattgtaaagcagtttacttttatgaaagagcggggtttcaggactgttcatatacttaggctgctggctgccaagagccctgcctgagaaagcaacaacagccccgtgatgatcatggatcggaaacatgacacggtttctgaagcggtcgaaatatccgcttccgtcttcgcgtctgatcaggagacccgctttttccatttgtgcctcactaaatcccctctttacaaggaatttcgtaataaagtcccaagaatcaagagcatagccaatctgaaattcatcaatcagctctttcgtaaagcccctagaaagcagataatccagtgcctcttgaccttcttttgtatttattaacaaatgatggtaaaatttcttcaggagctcatgtgcctcagccattttttgttctccagaagactctggccgggctccggaatggactgttatatcatctggaaaatcaatttggtatttgtcagcaaggtgagaaaccgactcggcaaaagaatagccttccatctgccttaaaaaagagaaaacattgccgcccgctccgcagccaaagcaatgaaaaatctgtttgtcgggcgatacggaaaacgaaggtgtgctttctccatgaaaaggacagagtccaaagtagtttcggccttgcttctttaattgaacataatcacctatgacttcaacgatatctgccgacttttgcacctgatccacaatttcatctggtatccgatttcccatcttataacactccgtcgtacattattcgatgctttagtgcaaaatcccttcatcgttcgacaggattttttgcagcagtgtaataaatcgttctcgatcttctttattcaattttttaggccctttggcatatacgccttttcttctttgtttgccggaaaaatgacggccctctagggcaaaatcaatcgtgtcttccttgtaaagacgacctctttccgacataacagagacatttctgttcaacagcagagatgctaatccgatgtcctgcgtcacaacaatatctcccggtttcacgtgatttgcgatatataaatcagcagcttctttatgaggatcaacatacttccatttttcttcattgcttctggaaagctgataatgttcaaatgaagcgacaaaaagaacttgaacttcatactcggatgctgtttgtaaaatttcatcttttaccggacaagcatcagcatcgacaaaaatcgtcttttcttgttcattaagaagagtaattctccatccctccattaaactcctgcataaaagcaagcaaaatcgcacatcctttattattgtggatgtatatgaatttgtcgaaaaatttccgggagaaattcttgacatcttacccataatagtttattcgtatcacacgatccttaaacctaaaattaatcattttatcacaattttttattataatacaaacttcacaaagatgctattgtttttcattattcccttttggcacagccaaaaacccaggatagagcgtcctgagttatatgttttttgttttgagatgatggataatatttgctgtttcctcaaccgctttatttgaaacatcaacaacctggcagccgatccgatccacaatcttttcgaaatactcgagttcctctttgattctgttgatatttgcataaatcgctttatcattaagcccgagtgattttaaacgttcttttctgatatgattcagtttatcagggctaatctttaaaccgatgcattttttcggatcaacgttaaagagttcttccggcggatcaacctccggtacaatcggaacattggcaaccttcaggcgtttgtgtgcgagatattgagacagcggtgttttagacgttcttgaaacgccgatcaaaacgatatcagcttttaaaatccctcttggatcacgtccatcatcgtatttaactgcaaactcgatggcctccacttttttgaaataatcttcatcaagctggcgcacccgccccggttcgtatttcgctgttaaaccgtaggctgtttccattttatcaatcaacgggccgataatatcataatataaaacatttgctttttccgcttcggctatcaaatattctctgatttccggcaccacgagtgtaaaacagataatgccgccgtctgcctttgcaagtgaaatcacttcattgatagtgcctatatcttcaacataaggaattcttcttacatgagtatcatccgccgatccgttaaattggctgagtgctgcttttactaccaattcagccgtttcaccgacggaatccgatacaacatagatgatgcggttattcatattatccccccgttagtttgcaatcttataggatttcattttcagataaactgacaagtattttggtcatatttgtttttgtcactctgccgatcacttcaaagcctttatcggtgtctttgatgacaggcagtgcatcaatttgtttttctattaagtgctttgcaatgtccatcacataatcctcgcgtctgcacaccgtaatgttcggcatccttgtcatgatgatgtgaacagggaccgatgtaagctcctgctggccaatgctcgctctgagcaagtcttttcgtgaaagcaccccgactaaaacagcatcgcggtccaccacaaacagagtacctacatcttctaaaaacatggtgcaaatcgcatcgtacacagaaacgttttcgtgaatcactacggggatagattgaaagtctttcacctgaagctttttgagtttatccgccaaaagctgtgtgccggtttttcccgtatagaaataaccgactctcgggcgcgcctcgaggaatcctgacatggtgagtatggctaaatccgggcgcaatgtcgccctggttaggttcagcttttctgcaatatgctcccctgtaatcggcccgttttcttttacaatctgcaaaatatgttcttgccgtttatttagttcgatcgtactcaccaccttttcacttcatagctatgtaaagaaataataatccatattataacgtaaatatcttgtaatcaaacaaaaaacttataaatggggaaaagacgattaccgatcacacagcaaccgccttttctctctttattttacaataagggcattcatattcgcaaaggacttgatctcatccgccaagcttaccatttgcgctaaacgatttgcctttaatgactcattatccgctataaccattgtatgatcgaagtaagcatcgatcggttcttttaaggctgcaagtgaagcaagcgccgcctcataatcttttttgctgaagttttcctgcagattttgcttcgctgtttggtaggcatcaaacagttttgcttcgtattcattttcaaaaagatcaggctgaatgtctccgcggactccttttttgctgatagagatcactcggcctaacgcttcggctgtttccttaaaaccaggtgcaccaagcttttgctccagtacttgtgctttatgcagcgcagagtacggctcaagctcagagctttccagcacggcgtcaatgacatcatgtctgatttgttcagcattcaagacatatttcaagcgctgagtgaagaaatccagcagttcaatttctttatcggtttgtacgaaagtaagcagctcttcaaatgaaattccccagttgcggtcaagaagaatcgcaacaataccgcttgcttggcggcgcagtccgtaagggtcctgggaaccggtcggaattacgccgatagagaagaatgaagcgattgtgtcaagcttatccgccattgctacaacagctccggtgaaagtagaaggcgtttctccgcccgctgatctaggcatataatgttcattgactgccgccgccacagcttcatcttcgccaagcattctcgcatacttttcgcccataattccttgaagttcagggaattcatatatcatatgcgtcacaaggtcgaatttagaaatttcagcagcccgcttcacatgttttaatgtatcttcatcagcctgaagacgaacggcaagtttctctgcgattgatgtgactcttctaaccttatcagcaagagaaccaagctcttcatggaaaacgatattttcaagcttcttcacatttgcttcaatgtttagtttctgatcttctttgtagaagaatgaagcatcagataaacgtgcgcgcagcactttttcattacctcgggccacattttcaatcgcgtggctgttgccgtttcggactgtgataaagtgaggcagcaggtcaccgtttttgtctttgacagggaagtagcgctgatgctctttcattgttgtgacaagcacttcttcaggaattgacagaaactcggattcaaatgaaccgtaaagagctgtcgggtattctactaaatgattcacttcatcaagaaggtcttcgtcaactggaatgctccaattgttttcagcagccattgcttccagctgagattgaatcatttgctttcggacgctaggatcagcaataacatgctgttctttcagctgctcttcataagctgaaggtgattcaattgacacttcatgtccgaggaaacgatgtccctgtgttgtccgtccagactcaacgtttgtgatcgaaaatggaatgacatcctgtccaaataatgcgacaatccatttgatcggtcggatataacgcaaatcttcatttccccagcgcatgtttttcgggaaatgcaagcttgtaattaaaccgctcaattccggcagaagcgacttcgtttcttggccggcttggaatttttgcacgaatacatactctatgccttttacttctttgatgtacaggtcttccacattcgcgccttggccttttgaaaagccgattgccgcttttgtccagttcccgtccgcatcaagggcaatttttttcgcaggcccttttgcttcttcttttatatcatcctgcttttctgcgacatccttaacgaacacagcaagacgtctcggtgtattgaagagtttcacttcaccgtgagtaatatttttttctttaagccagcctgtcagcttgtcgccaagctgaaccatgctttcattcaaaaagcgcgccggcatttcctctaatccgatctctaaaagtaaatcctgtttactcatgagaagaaccctcccctttaagcattgggaaccctagtttttctcgttcctcatagtaggtttttgctacttttctagctaaattccgcactcttgcgatatagcccgtccgctcggtaacagagatcgcacctttggcatcaagcaggttgaaagtgtgcgagcatttcagcacatagtcatatgctggatgaacaagtccgttgtccatttgcttgatcgcttctttttcatatgtgctgaacaattggaacagcatatcgacgtctgatgtttcaaacgtataaacagaatgctcatattcagccatcatgaataaatcttttactgtaaaccctggcgtccattccaagtcaaacacgttttctttatcctggatataagacgcgagacgctcaattccatacgtaatctctacagaaacgggtttacactctaatcccccgacctgctggaaatacgtaaattgtgttatttccattccgtcaagccaaacttcccagcctagacccgcgcagcctaaagacggattctcccagttgtcttcaacaaagcgaatatcgtgctcaagcggatcaattccaagagcacgcaaggaatccaaatacagctcttgaatgttatcaggtgacggtttaataatgacctggaactgatgatgctgatacagtctgttcgggttctccccgtagcggccgtctgccggacgtctggaaggctctacataagccactttccacggctcaggaccgatactgcgcaaaaatgtatacgggctcatcgtgccggctcctttttctacatcgtaagcctgcataagcacacagccctgactggaccaatgcttttgcaaggttagaatcatgtcttgaatattcatttcaagcacctccacttttctttcatcagttgactgcggcagcaaccaaaaaactcccgtctctatgcttgccagccgcaaacatagggacgagagttctcccgcggttccaccctagttgctgagaacaaaatcccagcctcttttttaaaattgctcaagaatgcctttcgttgcgtgctcatccttagcttacaccgccctaaggtcgctttcatgaggtaaacgcaagtacttctttctctcactgcaacatattttataataaatgatcatataaaaagatggaccaaaagtcaacttttgttttcacccataagatgtttcatgctttccatttgatctaaaaagcgctttgattttaaatacaatcccgaatattcttcgtaatataaatcaatcacatgctttaattcagcttttgtttcctcttttaaggacacattgccgagcctcgacagatcaaaatagtaaaagagtcttaacagccttgctgtttgcggtttgatcggtatcctgtaaggatctttttcaaaacagcggtggcatataaaaccactatcacgaacagagaaatgaaaggttccgtcttggcttttacaatgtacacaatgatttagctcaggatacaggcccatgacaccgagcatcttcatttgaacaatgaaggtgataacatccggatctgttccttcattcagctgttttaatgactctaatatgaattcaaataaataaggatttggctttttttcttctgtgcctctgtcgactaactcagcaatataggcagcatatgctgttaaaaacaagtcttccctgatgcctctcatgctgaggatcatttccccctgctgaagcgttccgaggcccgatgttttttgcattaagaaagaaccatacaaaaagggctggctgactgctgataaacggctgttcggttttttggcgcctcgtgccataacacctatttttccgtgttctcttgtcagtaaagttacgattttattcgtctctccgtaatcatttgtgcgaagaacgattccttcacattttgtcagcatttccgcaccttcctcaagcaggagcggccaagaggtttataaaattggataatcaaatcgggctagctcatcttctagttcttcgggtctttccatgttctctttttccagttctttaaaaagaagatacgtatcaacatttcctgtttgagaaaatacgttccaggtaaaattcaacacaagaaacccacctttctgtagttaaactagcttacctaaactccaaattcttacctttatcttgaccagatgtcctccatttcatgttaaacaaaatttgctaatgtatccctgttcctgtgagataatgacacacacagctagagattaatattcgtcctctttaaagccaaaatcgcgaagctgggacattttattacgccagtctttctgcactttcacccacaattcaaggtagacacgggagcccaacagtgcttcaatatccgctctcgctctttttccaacctcttttagaaggcttccttttttaccgatcacgatgcctttctgggaatcccgctcgaccacaatcgttgccgctacgtgcacagaaccgttgtcctgccctttgatggattcgatggccaccgcaatgctgtgcgggatttcttctctcgtcaaatgcagcaccttttccctgattaattcagaaatgataaatcgttcagggtggtcagttacctggtcactcggatagaattgcggcccttccggcaaatacgcttcgatctgcgcgagcaaggtttcgatgttatttccttctaaagcagaaatcggaacaatttccttaaaaggataacgtttgcggtattcgtcaattagcagaagcaattggtcgggatgaattttatcaattttgtttacgattaagaatacaggcgtagacatcgtctgcaatttctcaatgatgaattcgtcgcccttcccgtagccttcctcagcattgatcataaacaagatcaaatcgacttcttttaatgtattttgcgccactttcatcataaagtccccaagtttatgcttaggtttatgaatccctggtgtgtcaataaaaatggtttgtgatgtgcctgtcgtcagtactccttgcaccttgtttctcgtcgtttggggcttatcgctcatgatcgcgattttttgtccaatgactctgttcaaaaatgtagattttcctacgtttggtcttccaataatggatacaaatcctgatttaaagctttcgttcgtcatgtaaatcctccgatgaaaatgcgcctggcaataattcttccacagtcatttcttttatttgtccttgtaaattagtcagtacgacaataacgtcttttgtgcaaagctcagaaatcacctgtcggcaggctccgcacggagatactggtccaggggtgtcagccgcaacggccagcatctgaaactctgtatccccttcagaaacagctttaaataaagcggtacgctcggcgcaattgcacatgctgtatgccgcgttctcaatattgcagcctctgtacacttttccatccttggtaagaagagcggctcctacttggaatttggaatacggcgcatatgccatatcacgcgcttttaaagcttctgttattaattcttgtctgttcatgtgtacattcctctcttacctataatggtaccgctatcactttatattttacataatcgcgcgctttttttcacgcccatttctaaaaatgtaaaataaatgtaagaattttcagccattacagctttggcaaaaaaataagtaaaccaatgatacacgaaatcacggcaaaaacgcaaacagccccggcggcagcgtccttggccgctttagcaagagggtgatgtttgtcagttattaaatcaaccgtatgttcaatggctgtatttaaaagttcaagcgaaaacataccacctatcaaaaggaatataatcatccactcaataatgctgagctctacaaggaagccgcaaatgagaacagcgcaggcggctgcggcatgaaattggaaattccgctccgtccgcgctgtttcccagatgccccggcctgcatgcacgaagcttttgaagaatcgcttcagctcatttctatgatcttttgagtccataagcgtccagcaattccttttgcttagtaaacatctcctcttcttcctctttcgtcatatggtcatatcctaaaaggtgcagaaatccgtgtacagctagaaatccgagctctcttttaaaagaatgattatactcctctgcctgctctcttgtgcgatcggcactgatgataatatcacctaaaaccggaggcatttcggcgcccacgatttcgatctcgccttccccctcttcttcaagagcaaatgagatgacatctgtcggagcatcctttccccggtattctttgttaatctgatgtatgtcatcattggaaacaatcgtgacagaaacttcagcctgatcctgaacgccttcacgctcagcggcaaattgaagcagattttctacttctttgagcatctcttctgagacgcttcccgtttcatcaacgatatcaatcagtaaactcatctatttcaccttcttagtagcctccggatattcaatccgggagtggaaaattccttttaatgttgcacagagcgtttttgcgattgtatccagctctttaaatgtcaaatcgcattcactgaactgtccgtcctgaagcttatcggatataataccccggacaagcttttcaattcgttcaggatttggattgtgcatggatctgacggccgcttcaacactgtcggccactgatataattgcggcttcctttgactgcggcttcggtcccggataacggaactcttcctctgtaatctggtcgcctttttccttcgctttatagtaaaaaaactttaaaagcgaggttccatgatgctgctcagcaatatcgacaagctctttcggaaatttatagcttctcagcatattcgcaccgtctgtcgtatgcgagataataatatttttgctcaactgaggtgacagcttgtcatgcggattgtcaatattcatttggttttcaataaaatattgcgggcgctttgtttttccgagatcgtgataatatgcgccgactcttgcaagcaaaccattagccccaaccgcttcacaggctgcctctgataaattggcaaccattacactgtgatgatatgtacctggtgtttccgtcagtattttgcgcaatagcggatggttaggattagacagctcgagcagcctcatggtggataaaatgccaaagcccgtctcaaaaaacggcatcagaccgatgatcaatacagatgaagcaaaccccgacacaacccccatgagcattaacgtgccgatctcaagacccgacagcgcagtgttctggatcaataataaggatagaacgacaaccatattaataaacgccacgaaaagtccggtctgcaaaatctttgatcttgcattgtgttttcctaaaaataatacacctgaaatgccgctgatcaaataataaatccctatgacataattgaatgttcctgtcacaccctgattaaacatcatacttccgcaaatcgcaagaatgatacttcccaaaatggcaatgcgttcattcatcagcagtttgattaagatggcgccggccgcaatggggaccagatagccgatattattatactccatcttctgaaacaaactgacaacctccatgatcacaagcaaaagtgttgtgattatggagaataacagaatggattggtttttaaacttcagattttgtttctgtttttcaaaataatatacaagtgttgcaatgaaaagtccgatcataatcaatagcccgctgatcggtttaaagagatttgagttatttaataacccggtcagctcaagttttctgtacacttcccgatcaatgaggtcattttcttccacgagcacttgcccctgtttgatttgaacctgctggacattatctgaggcttcctgccgttttgcctctgttgctttcggatcgaagacgtaattcggaataatagcaaaacgcccgatttctgtcgcagctcccaagtatttagaaggaatagaattgctttttagctctttttctaccttatcctttgcatcagatagtttatccgaggggatttcactgctcatgaccgtatttactgcggtaatgaccgtatctctgacaaaagaaaagtcttcactgtctgctttcagcaatgtcttgatggaatcctccgatatagaatcattcacatctgatgtcaatttgtcctttacagatttgaccattgatttttccgatggtgatttactgccttcttccgatgattttttcacttcactaatactgtcgaatattgatgacacaaggtcaatccgattgtctgtatattctttttttaatgtatattgatcttcaaccgcgtcctcagcggcttgctttttttcctctgtggctttttgatcttctacggttgccggagcgtaaatggtcttgtcgctgactgaaaacaggtctaaatcaagtgtttccggcttaacatgtacaaaaagcaaagcaaacataatggcagccagcagaagatacagcagtacatgcatggagcgggcatttttaaaactgctccattttttcgagctgcttttggtcttagccttctttttcaacacaagaacctcctcttgaaacatcaagcccataagcaatcataaaaatgacccgataacgcgcgatcgggtcattcagcattaattttgcttatcgtatgcttcaataattttcgcaacaagcggatgtctgaccacgtctgtctggtctagctcaatcatagaaatgccgtctattcctttcagcatctccttcgctactgcaagtcccgatttgacgcctttcggcagatcaatttggctgacgtcacctgtaatgatcattttagagccaaaacccagtctcgtcaaaaacattttcatttgagcaggcgtggtattctgtgcttcatcaagtataacataagcatcatcgagcgtccgccccctcatatatgcgagcggagcaatttcaatgatgcctctttccatcagacgttctgtatgatctgccccaagcacatcatggagagcgtcatacagcgggcgcaaataaggatctactttttcttttaggtcacctgggagaaaaccaaggctttcaccggcttccacggcaggtcttgttaaaatgatttttttgatatgtccgttttttaaagcatggactgcttttacgacagccaggtacgttttcccggttcccgccggaccaatgccgaatacaaggtcattccgcttcatagcggccacgtattcccgctgtcccattgtttttacacggattgatttgccttttgcgttttttgtaatttcttcttcatacatgctttcaaagtattcaagttcattcttctttgccattttgatggcgtaaatcacatcacgttcagagatctctatccccttgcgaattaaagcgaggagcgatcccagcagcctgtctgcaatctgaaacgattcatcatcgcctgaaacataaatcgtctcgccgcgcgtaatgatatttacattcagatctttctccatcaatttcaaaaaagaatcttggttcccgaagagtgaaagcgcctcgtccgggtttttcagtttttgattcatcgcaagtaaatgttctgtcattcttcagtctccctgacaataggtgtggtttgaacgatatcttctataacttggtagagaataatcaactttactttaccattctcaacagtctggtgcaaaactttttcacttttcacctcgccgttttcgcctattttatcctctacatcctgtttacccaatttaatgccttcttgaactgcttcttctttcgtatattttcgcaaagcctcttcactttctctcgtttgctctttgacataggatacagggagcttaaatccgagaaaatgaagcgaatgcttttcttgttctgtttttggatgcttcaattcctcttttttaaacgtcatcccccagatcgggattgccaaagaaccaaaagaaagcttgtgctttgtccttactttgcccgtatagacgttaaataatgtttcaagcgggactgtcacttctgatctataccaggtttctccgtaaatttctgcttttgaggcgacttcctgctgatggtcttcgctgccgatcagtcccgaaacaagcagttgccccttttcaacgtgatcgtgtatggcggccatgggctgtcctttttgcacaaacattctcgtaatggttgctttctttttggcgacaatattgcgcgggctaacatatttttctttttcgggctcatttttctccacaactttcatgtgaatggtcgtccccttcagatcaactccgacccaagtgatattgtctattccattggttaatgatttctgtattttttcgggtgacatcattaaaaactgcagacggccctttttgacgccgatttcattaagatgctgcctcatttgatgttctgtttcaggcttagcgcctgtcacatcaattttccacaccatattggacagcaaaaacaaaagaatgaaaaaaatcgcaaaaccgatcgtaaaccctatattcagctttgatttcagcaacaggaagggaaatcccttccgattgataaatcgggctttacatttaaatttacttcttacccgccgaaaggcatgtacatcctgaagctgtatatataacgatacggcttctttcttttttttgacatgaaagaccggaatcccctgtcttgtgcattcattaaggagccgttcaatccctcttcccgtcaattcaagctggaccttacccgaaaaaaaagacagccatttatttttcacaacatttccccctcggctttatgactcaacatatcgaacgacatcaatcgtaccctccaaaagtatctcttccggaagaatcgccttgatgacaaaatttttaccagatatgatgcactggccctgcttcagcatcagcctcacttcattctcactgaaaagcaaaagacctctgtggttttctatgtagatatgaagtctgccaaccattgtaatcctcggcagatccatcataacgtccgggggaatttccaatgctcttgtcagccaagctttcatacgattctttctttgccccatacaaaaagaaccccctttcatctcatatgtatgatttgaaaggaggttctaacactttaatttttacgagccgggcgcatcgtacggtgaggttttttcgcccgtggaggtccgaacacctctcctagaacgatcccctgtacgacggtgtctttattcacctgaagcattttttgttttgtgtatactgttttttgtttggcagcagcaagatctcgttccagccctttcaggtttcttgctgtttccctgcgtctttcttccgcttcccgtcttgcctgttccatacggttagggataggtgcaggggcatcttcttttgactgcttcttttgaggagaagcagattgcacgtgttgaggtttttttcttttttggctgttttgcttttcttctttgctctttttaccgaaaatcgcagaaatgattccgatgatcgctgcaataataagcggattggtcagtaaatcttccatcagcgttctcccttcttagagagattatgatttgcggtcttcatccgaagggtctttcgtcagcttgccgaatgaatcacgcatttctgtgtcagcatcgatgttcttgatattcatgtaatccatgacgccaatattcccttcacgcaaagcttctgccatcgcaagcggcacttccgcctcggcttctactactttcgcgcgcatttcttctacgcgggcacgcatttcctgttcttgagcgacagccatcgcacgtcgttcttccgcttttgcctgcgcgatgtttttatcagcctcagcctgatcggtttgtaaaattgcaccgatgtttttgccgatatctacatctgcaatatcaattgagagaatttcaaacgcagttcctgagtccaatccttttccaaggactgtctgagaaatcatgtcagggttttcaagcacttttttatgattatcagatgaaccgattgtagaaacgatcccctcacctacacgagctacaatggtttcttcccctgctcccccaacgaggcgctcgatattcgctcttactgtgattctcgctttcgctttgacttcaatcccgtccattgcgacaccggctatgaacggtgtttcaatcaccttaggattaacgctcatttgaacagcttccaacacgtcccggcctgcaagatcaatggcagcacagcgctcgaatgtgagttcaatgttagctcgctgagcggcgataagcgcgttgacgactctgtcaacattacctccagccagatagtggctttcaagctggtttgttccaacattaagtcccgctttatgcgctttaatcagcgggttaacaacccgattcggaatgacgcggcgaagcctcatcccaactagagtgaaaatgctgattttcactccggctgccaaagctgaaatccaaagcattacaggcacaaatgtaaaaaatactgccaaaacaatgatcgctactgcgacaattgccagaatcataagtgttgacggatccatataacttctcctcgtttctatttaaatttctctcacgacaatgcgtgagccttctacttttatcacttttacttttttatctttttctgtaaacgatccctccgatacaacgtcaaggcgttcatcatcaataatcacggtaccggaaggacgcagcggtgtaaaggttatacccacttttcccattaagtccgtgcgcgtttgatttgaaacgtagccgctctccgtgtttgtagaatcatttaatatcaatttcttaaagaatttcatacgctttcccaacacccttgtcagtaaaataaaagctgtaatcgaaacagctgaggcgatcaagagagaaaccgccatgacagtgaagctccccgcggctaaaaacaggctcgcaataatcgctcccaagcccagtaatccaatgattcctccgggaagaaaaatctcaagcagaatgagaatcacccctgctataaagaggagaaccgtctcatacccggcaaggccggctgcaagatgcccgtaaaagaacagcaataacgcaatgagtccagccgttccagggaggccgacacccggggaaaaaagctccaccgtcagacctaaaaaagcgattgtcagcagaatagggacaatgaccggattcgtcagccatcttgctgtcttttccgcaaagctctcctttgcgtagctaatctgcgccttttcgaacccaagcttctttacgagcgtggacaaattgtcagcagtgccttctgaatagcctacctcaattgccttgtctgcgttaagtgtcagcagatctcccttaggcgcgccgacttccttggcatctatatctgggtcagccattgcgagcgcatattttggatcgcggttatttttcactgcggcatcttccatctctgccagccaaagtgattgagctttttggtcagcggcattgccttggccatcaacaatcgcggcggctcccatttttccgccaggcgccatataaatgtgatctgcttgaagtgcaatatatgcaccagcagacaacgcgcgtttgttgacatatgcagttacggggatctcgctttcggttatcaaatcggccatatcaatagcagatttgaccaatccccccggggtattgatatcaagaataatatggtctgcatgtgcatcctttgcgtcttgtaacgaacgggacaaaaacgaggcgagaccctgttcgacatttttttcaaccgggatcacataaacagtttgtttttctgcttttgcgttcagctgtacgcctaataaagaaagtaaaaatatacccaaaagagcagcacggaatcctttgatttgaagcaagggcggtgtatccctccttccttttataataagtgccttctcttcatacgtaacaaatgtatcaaaggtttcatttttttatgtataaaaaaagacatctctcttagaaagatgtccttttctttgccatttaagacagttgactgctcacaagcttattaattaaacttccgtcagctttaccttttactttaggcataattgcccccatcactttgcccatgtccgcttttgagctcgcaccgacctccgcgatggtatcatttacgattgtacgcagctcttcttctgacagctgctcaggtaaataaacttctaaaatgtccagctctttttgaactttatctactaaatctaaacgattagcgtttgaaaattcctggagggagtctttacgttgcttaagttcacgagaaaggacagtgagttcctcatcctcggtcaaactgtctttcttaagcttaattgcttcattttgaagtgaagccttaaccattcgaacgacagtcagtttgtctttctcacggtttttcatatacagcttcatatcctggttgagacgctcaagaagactcataaatccaccctcttttagaatttgcgttttctagcagcttcagactttttcttgcgctttacgctaggtttttcataaaattcacgctttcttgcttcttgcaaagtacctgtctttgatacactgcgtttgaagcgacgaagagcatcttcaagcgattcgttttttctaacgaccgtttttgacattctctttccctccctccgaatacaccaatcgactacctttaagttacacatataaacatgtactttgacattataatataagccatcagtcaggtcaactaagtgagttcacttttccgtcatgagtgcgactgcctgtctatataatgatagaaaggggttggtgaataggatgttaattctgattagctttactgctcttatattattctttctcacaggcatgaacatgcttcgaaaaggcttaatttctatggcgtactcaaaaattgaagatcgtttgcttttatttacagaccatccgttaaaagcgtttcttatcagcattgtatttacggggatacttcagagcagttcagcctttatggtcattgtcatcggctttgtaagtgcgggcgttctttcttttaagcggacgataccgatgattctggggacaaatgttggctctacttttacaactgaatttattgctatcaaaatggatattttgatttgggttcttttaataggaggtttattgttttttctgactggcaggtatcctttgaaacagctgggaacaagcttcctcggactgggcatcatcttcttttgcatcagcggattcagccaccttgccgggccgctgacgaagctgaaaacgggagccgacgttctataccatgttaacgattcaaactggtccgctttgctcatcggcatggtgttaactgccatcattcactccagttctgtctgtatcggcattttgatgagttttatgaatgaagggattatcggactgacacaggcgatgagcgtcgtactcggatccaatatcgggacatgcattacagctgtcatggctgctgtatccggtggatatgcggcgaaacagacagcgtatgcgcatgtggtatttaacgtgctaggggtggctctagtattgccttttctgaccgcagcgaccggctttgtagagcagttatcacccgatcccgcccaaaggattgctcatttcagccttttatttaatgtagtaacagctcttttatttcttccgcttacaaacttgttttaccgcttgattcaccttcttatcccggctaaataaaaaaccggtacattttaatgcaccgattttttaggttaagaagacaaacgcatgtgttcagttatttcatcctcaaccacacggacaaactgtccttcgttgtaaggataacctgcttttaggattttgacttttacgattttgccgatcatatcttccgtacctttgaaaacaaccttcatataattgtctgtgtaaccgacaaacatattttcttcttctgtttccttaaacgcttcctcagggataatctcaagcacttcattttcatactgagaagcgtattcttttgcaagctggtcagaaagagcaatcaggcggtgcacacgttcgtttttcacgttttcatccacttggtcttccattcgcgcagctggtgttcctgtacgtttactgtaagggaaaacatgcagttcagagaatttatgttctttaataaagttataggtttccataaattcttcttctgtttctccagggaatccgacgatgacatcagaagtaacagctaagcctggcagtgcttttttcaatttatttaaacggtctgcaaagaattccattgtatatttgcgtctcattcgtttaagcactgtgtttgatccggattggataggaatatgcagatgattcactatcttatctgagcggtctaagacctcgatcacttcgtcagtgatttggctggcttcgatggaagaaattctgatccgtttcacgccttccacacgggtgtctaattcgctcaaaagcttcgcgaagttgtaatctttcatatcttcgccgtagccgcctgtatgaatacccgtaagaacaatttccttatatccggcatcaacaagctgctgcgcttgtttaatgacttcttcaggatcgcgggagcggagcaggccgcgcgcccacggaatgatacagaatgtgcagaaattattgcagccctcctgtatttttaatgacgctcttgtgcggtccgtgaaagcaggcacatcaagctcttcatatactcttgctttcatgatgttgctgacgccattaatcggctggcgttcttctcggtattggtcaatgtagccaagcattttttcacggtcctgtgttccaactacaatgtcgacaccggggatcgccataatctcagcaggtgaggtttgcgcgtagcagcctgtgacacagatgacaccgtcaggattttgacgaatggcgcgtctgatcacttggcggctttttttatctcccgtatttgtaaccgtacatgtattaatgacatatacatcagctgtttgttcaaagtctcttctttcatagcccgcttctttgaaaagctgccagattgcttctgtttcataatggttgactttacagccaagcgtatggaaagcaacagttgccattactgatcacctcttaataactctgtttgataagaaatcgcgctcaatgcgtatagcggagcggtttctgtccttaaaattctcggtccaaggccgcacgtcacaccgtcttgctctgtgagccgttcaacctcagcttctgttaaaccgccttctggaccaaatacgatcaatagagatgatcctttcggaaggctgcttacaatcgcgctgaatgcgcttatttccccttgcttcgatgactcctcgtatgcaacgacacatttatcgaaatcctgcatcctttgaagaagctgctgaaaagaatggacatccatcactcgcggcacttcgttacggtacgattgctcagccgcttcctttgcaattttcgtccatctttcccgctttttctttgcctttttgtcatccagcttgacaacagaacgcgcggcttggaaaggaataaaggcatgagctccgagctcagtccccttttgaataatccattcaagcttatctcctttcggaaggccgctcgcaatatagacctttatcggaagctctctgtttttattcgtccattctatcacaaggcaggacactttatctttggaaacagattgaagttcacattttgcctcgaagccgtcttgagagcagcagataatctgatctccctcattcattctcatcacgttcacaatatgatgaacatcttcgccggtaatcgaaaaagccggcgcttcctctatttgctgcttcgtgagctcgataaaatatcgttgcatacgctgtgacacctactaactgttattttttcgcaataatgctgacccaatcttccattgaaaggatttctacaatggtaaagccagcttgttccagtgcttcttttacttcttgttttttatgaccgatgattcctgacgtaataaagtggccgccttcttttaacaggctgtacgcttgtgaagtaaagcgaagaatgacttcagccaaaatgttggccacaatcacatcatgttccccttcaatcccgtctaacaaattgttttgcttcacttgagcaatatcgctgactttgttcagcttgagattgaggcgtgcactttctacagccacgggatcaagatcgtaggcatgaaccgattcagccttaagcattgcagccgcaatacttaaaattcccgaaccagtgccgacatcaatcaccttatcacccttttgcacaaagcgttcaagcgcctgaatgcagagtacggttgtcggatgtgtccctgtgccgaaagccattcccgggtccatttcaataatcagttcatcagtatggaccggcgtatattcctcccacgtcggcacaattgtaaacttttcagaaattttcacaggatgataatactttttccaggcagtcgcccactcttcttcatttacttcagaaatagtgatgtggtttctgcccaaatcaatattgtaaagaaggagattattaatcgtttctttgatgccgtctacagtttcgcccagaaaactgttaaccggcagatatgctttgacaatgacaccctcatctgggtaatcattggggtcgagctggtagatttccccgtacacattctcacgttctttaattaaatcaagcgggtcctctatcacaaccccacttgcaccagcttcatgcaatatatttgagataggttcgaccgcttcatgtgttgtgtgaatgcttaattcggaccatttcaaaactaccaactcctcatccaataattaatcacctttaaacgcgcgttttaccttgtcaaagaaactcatttcctgttcgtcaggcaggtttccgctgacttcggcaaattcgcggataatgtctttttgtttatcagtcagatttgtcggcgtaacgacgcggacgacgatatgctggtcaccctgtccatagcctctgacattttgaacgcctttgcctcttaatctaaatttcgttcctgtttgtgtaccggccggaattttcaatttcacttttccatgcagcgtcggcacttctacctcatctccaagagcagcctgagcaaacgttaacggcatttcacagtaaatatcatcgccgtcacgctcgaagaactcgtgtgcgcgtacatggaacacgacaaataaatccccagcagggccgccgtttattcctggttcaccctgtcccgagagacgaagctgctgcccgtcatctacaccggctggaattgtcacattgattttcttgcgttttttgatttttcctttgccgccgcaatccgcacatttgtttttaatgattttgcctgtaccttcacagtggtggcagacccgtctgttaacgacttttccaaacggtgtattttgctccacgtttaactggccggagcctccgcagtgggagcatgtttctggatttgttccaggtttcgcacctgagcctttacatgtctcgcacgtttcctcgcggggaatttcgatggttgtttctttaccgaaagccgcatcctcaaacgacagggtcatcgtatactgtaaatcagcaccctggcgcggagcatttggatctctccgtcttgtgcctccgccgaaaatacttgagaaaatatcatcgaaaccaaaaccgccgaaatcgccgccgccaaaacctccgccgccgaagccttggttagggtcagtgtgaccaaattgatcgtaatgcgcacgtttttggtcatctgacagtgtttcgtacgcttcttttacctctttaaatttttcatctgatccggcttctttgttaatatcaggatgatatttttttgacagcttccgataagcttttttaatttcatcctttgaagcgctcttacttactcccagcacttcatagtaatcacgcttactcatctcgcttcactctcccgaatttctcacataaattagattgtatcattttgaattatgatttttcaattccttttatcccgggcaagaaaaaaagtcaaagccaagagatgcctgactttgactttctaatcattgaatcagattatgaaatgtgttcttttcggtcagctccgaaagcggggctgacactaaaaagaacttattttttgttttggtcgtcgtttacttcttcgtattcagcgtcgacaacgttgtcatccgctttgccttcagcgtttgctccgccttgagcttgctgtgctttagcagcttcttcataaagcttcatagaaagctcttgaacgattgtttgaagctcatcttttttcgctttgatctcttcaaattcgtttttctcaattgctgcttttaaagcgtctttggcatcgttggcttttttcacttgttcttcatccactttgccttcaagatcttttaatgttttctcagtttggaaaacaagctgatctgcttcgttgcggacttcgatttcttcttttttcttcgcatcagcgtcagcattttcttccgcttctttaaccatgcgttcgatctcttcatctgaaagacctgaagaagatttaattgtaatgttttgttctttccctgtgcctaagtcttttgctcttacgtttacgataccgtttttgtcaatatcgaaagaaacttcgatttgaggcacgccgcgcggtgctggcgggatatcagtaagctggaagcggccgagtgttttgttgtcggcagacattgggcgctcaccttgaagaacatggatatcaacagctgtttggttatcagcagcagttgagaacacttgagatttgcttgtcgggatcgtcgtgttgcggtcgatcagttttgtaaacacgccgcccattgtttcgataccgagagaaagcggtgtaacgtcaagaagaacaacatcttttacgtcacctgtgataacgccgccctgaatcgcagcaccaagcgctacaacttcatccgggtttacgcctttatgcgcttcttttccagtttcttttttgattgcttcttgtacggcagggatacgagttgatccgccgacaaggatgactttgtcgatttcgcttgcagaaagtcctgcatcttgaagcgcttgacggacaggacccattgtgcgctctactaaatgagaagaaagctcttcgaatttagcgcgagttaatgtaagttcaaggtgaagcggtcctgcttctccagctgtgataaacggtaaagaaatttgcgtagaagatacgccggaaagatcttttttcgctttttcagctgcgtctttcaaacgctgaagcgccattttgtcttttgataaatcaatgccgttttcttttttgaattcagacacaagatgatcgatgataacttggtcaaaatcgtccccgcccagacggttgtcgccggcagttgaacgaacttcgaatacaccgtcgccaagctcaaggatggaaacgtcgaatgtaccgccgccaaggtcgtatactaggatcgtttgatcttcatctgttttatcaagtccgtatgcaagcgctgctgcagttggctcgttgatgatacgttctacttcaagacctgcaattttaccagcgtcttttgttgcttgacgctcagcatcgttaaagtatgcaggaactgtgataactgcttttgatactgtttcgccaagatagctttcagcgtatgatttaaggtgttgaaggatgatagcagacacttcttgtggagtgtaatcctttccttcaatttcaactttataatcagtacccatatgacgtttgactgacataattgtgttagggtttgtaatagattggcgtttagccacttcccctacttgacgttcgccgtttttaaacgcaacaactgatggcgttgtgcggtttccttcagcgttagcaataactttaggctcgccgccttcaagcactgccacacatgagtttgttgttcctaagtcgattccgataactttactcacttgaataacctcctgctatgtaattattgattcactttgaccatggaagggcgaatgacgcgatccttcagcttatagcctttttgcatttcctcaacaacaatgttggagccgtagttttcgtcttcagcctgcataacagcttggtgcagattaggatcaaattcctgccctacagcttcgatggcttcgacgccttcttttttcaaggcttctacgagctgacggtggaccatttccattccctggagcaaacttttcgtctgttcattgtcggcttcaacctgaagcgctcgttcaaagctgtcaagagccggcagcaaatcagtcacgatattttgagaacggtatttttgggacgcttccatctctaaacggctgcgtcgtttatagttttcaaagtctgcttgaacacgcaaaagtttgttttctttttcctcaagcaaaccttgcaattcgttaatttggttttgaagaagttcgctttcatttgtttcttcctgctgttcatcagcggcagcttgttcttcaatgatttcttgctcttctgtttcgttttgttcaacggtttgtttttcttctgacattgtgttcacctccctcaaagtgtaaggagaaggacaggtgctgcccttcgataaaatttgccaaaattcccttattcatcatacagacttgttaatgcttttgacaagtccgaagtcacatgctgaagcaggctgacaaccctggaataattcatgcgggtcgggccgataatcgcaattgagccaatctgcttctggtctacggaataagaagccgtaatcagactgcaattttccatctcttcatagtcgttttcttttccgattttaatcgaaattcccgtgtgcggggattgaaccagctttaaaacatcctgttctttctcaattaatgaaaggagcgaccgaactcgggtgatatcatggaactcaggctggttcagcatattgattttcccgccaaaaaacaacttttcaacgtgatttgtggaatgaaaggttgaacgaagcgcgtcgagtatattgtcatagttcttaatgtgctgtcttaggtacatgacaacttctttaaatatgcgctcattcagttcatccattggaacgccgcttaaacggtcgttcagtatattgaccagtttttcaatatcagacagatccattttggtcggaaagttaatcgttttgttttccacatgccccgtattggtaacgagaatcgctaccgccatatcaggctgaatcggaatgatttgaatctgtttaaggtaattctcactcagcttcggcccgagtacgatggatgtgtaattcgtcagatcggacaaaatttgcgctgatttttgaactgtcttctccagctcgaaaattttctctttgaagatcgagtggatttggtccaggtcgcttttcgtcagtttgacgggtgacagcaaatggtcaacatagtaccgataccctttttctgacggaacacgccctgaggatgaatgggttttttcaataaagcccaattcctccaagtcagccatctcgtttcttattgttgcagagctaaatgtgatttcatcttttttcgaaagagttcttgatcccaccggctgtgccgatttaataaaatcgttgattataacctgtaggatcagcagctgacgatttgttaacatcatcatcacctctgttagcactctcaataagcgagtgctaattctataacaaaagtatcaaaccacaagaaaaatgtcaattataactcacccaaaaaagcgccaaaaacttcattgcctaataatttcccttgatgagtcaaataaacggcagactccgaattgtgaatcagccctttttcagcgaggtcttttaacacgcttgggaaaagtccatccagggagcggccgtatttttctgcgaatcgttttttgctgacaccggctgtttttctcaaacctaaaaacatttcttcctcaatctgttcttctgttgtcacttcatgtgtatctctgtacggaaaacccttttcagctatcaggtcaatgtaatgcttaacaggtccgacgttcactgttcgtgtgccgccaatatatccgtgagcgccggctccgaaaccgaaatattgttcgttgctccaatacgttagattgtgcttagattccatgcctgccttagcaaagttgctgatttcatattgatgaatgccgtgagcttccatctggctcatcaccatttcatacatttcagcttcctgctcctgcggcggaagatgaagccgccctttttgcatcaaattataaaataccgttttcggttctacaataagggagtaaacggaataatgctcggcgtccaatgataaagcagtgtttatggaatgttccagatgcttgagggtttgccccggaagcccaaacattagatcaagactgatattctcaaaaccgatttcccgcgctctttcaaaagaggtgaatacatctttttgcttgtgcactcggccgattttttctaacagatcgtcttcgaacgtttgcacaccaaagctgaggcgatttacgcctgcttcttttaatatttttaatttctctgcggacaagtcgtccggattcgcttcaaccgcaaattccgataagtcgcttgagggcttcagcacgcggttgatcatgtccatcagctttttaagctgttcctcagacagggaggtcggcgtgcctcctccgataaagattgttttgagatcaggctgcccggtttttgctattgtatttatcatttcctgttcgagtgcgtttaaatacccgtcgactggctgactttgaataaaatatttattgaaatcgcagtagtggcaaatatgctcacaaaatgggatatggatataagctgatttcaaatggattcaccttctttacagaaagaagccgcagtacaagactgcggcggcttctattgttttttcggactgtcgtccattttcagaactgccataaatgcttcttgcggcacttcaactgagccgacctgcttcatacggcgttttccttctttttgtttttcaagaagtttccgtttacgcgagatgtcccctccgtaacatttagccaatacgtttttacgcattgcttttatggtggagcgggccacgattttctggccgattgcggcttgtaccggaacttcaaactgctggcgcggaatgagttctttcagtttttcaacgatcacttttccgcgttcatatgcgtaatcacgatgcacgataaaggaaagggcatcgattttttcaccattcagcataatgtccattttcacaagcttggacggtttgtagccgatcagttcataatcaaaggacgcatagcctttagtgcttgatttcagctgatcaaaaaactcatatacgatttccgctaatggcatatcataaatgatgctgacacggtttgcgtctaaatactgcatatcaataaaattgccgcgttttccttggcaaagctccattacagcgccgacatagtcattcggcaccatcatcgtcgcttttacgtatggctcctcaaccctttcgatcttttgaggatccggcatgttggacgggttgtcgacaacgaccttttcgccgtctgtcatatacacatcatagataacgcttggcgctgtcgtaatcaggtcgatgttgaactcacgctcaattcgctcctgaatgatctccatgtgaagcatgcctaaaaatccgcagcggaacccgaatccaagcgcttgcgaagtttccgcttcatattgaagggaggaatcattcagctcaagcttttcaagagcttcccttaaatcattatacttcgctgtatcaatcggatacaaaccacagtacaccatcgggtttagcttgcggtatcccggcagcgcttcttctgcaggattggcagcgctcgttattgtatcaccgacacgtgtgtcaccgacatttttgattgaggcagtcaggaagcctacatcaccgaccgtcagttcatttgtcggagttgctttcggcgtgaacacgcccacctctgttacttcgaattctttgccggttgccatcattttgattttttgtcccggctttaccgttccttcaacgactctgatataagccacgacaccgcggtaggcgtcataaagcgagtcgaagatcagcgctttgagcggcgcctccggatctccggtcggagctggcaccttttctacgatttgttctaaaatctcctcaatcccgataccggcttttgctgaagcaagcacggcttctgatgcgtcaaggccgataacgtcttctacctcttggcgcacacgttcgggctcggcgctcggaaggtcgattttattgatgaccggaaggatttcaagatcgttgtcaagcgctaagtagacattggcgagcgtctgcgcttcaatcccctgggctgcatccacgacaagaatcgctccctcgcaggcagcaaggcttcgggatacttcatacgtgaagtcgacgtgtcccggcgtatcgattagatgaaagatatattcttctccgtcttttgctttatatttaagctgaacagagtttaatttaatggttatgccccgctcacgttcaagatccatagaatcgagcaattgttctttcatttctcgttgagtgattgccgacgttttttctaaaatacgatccgctaaggtcgattttccgtggtcaatatgggcaatgatagagaaattccgtattctcgattgcctctctaaacgcttttctttatctgtcacaatctatcactcctactattaaacgcaaaatacactagcttagattatatcaataggattgtaaagattcaatgtaaaacaagaaagagaaaagttccctatcatatctgggctgcttttctctttcacgtacttattgattcatatcccgtatccattcatacattgactgggcagtattggttacggtgttcgaaagcgcttgtccggcttttgaaaacatattgaatgtctccaccttttccagctctttttgtttttcttctaaatcttttgccgtgactgtttctcctaggattgaggcttctttttcattatcttttccgtcggtgagcgtaaacgcccccctcagtgaagggtcatgatagcctttcatactcagcatcccgttgtttgcctgctgcatgccgaacagaacgcctaaaaacatgatcgtgacaagcagtaagcattttccaaagtatgcaatcaaatcaaccacctatttcttattgttttttcgtctccccgctcgctgcgttgaccttttcagcatcccagtacatttcgctgaatacgtccgcggccgcgttagccgcacgctgcagctcttcgagattattatctactccgccaaactcgagcaaaagcgctctatcggttaaatcctgattgtaaacaccattatcgcctggcgagcctttggaaaagacacctgtgctaagtccggggtattttttctccatcagtttatgaagctcactcgcaattttatagttttcttcgaagtttttgctttttttcccgacgacaaaggctaccctggcatagctttttcctttaatcgttgcggttgtgtcttttttgcgccgtgagtctctgtggatgtcaatgatatattgcaaatttttgtttgaagcgagggcgtctttcacgaccggccttgattcatcataggacctggcatagtttaagccttttttattcaattttgactgtatatcggttttattcactgtggctccgattccctgggattcaagcgcttgtccgaacatatctcctacaagcgtgacattggctttagaatggcgcgccatgtcaggatcggtctcgccttttaatagagggagatatgattcggtattgtgcgtgtgatagataaacacgacctttttatctcctgttgtttgtttgggcggatctttttgcgcattatctgattgcgtttgctgtttttcaatctctgccaaattcgcttccctttcttcctccatcaccttagacggcggcggcgattccgcaggcatattcgtataatcggttccttgtccagctaacaaaatctcggtatcaaattgtgcaaaccctggcagctcccgaccgagaaagctccgcggatcttcgaggttaatgctcgtcgccagctttaaagaaagacgagaaagatgaaatgagctgtcggtttgagagaggtcagaagcgaaataatggttttccatccgcagcaaatgtgcaaatacgtcacccggcaattcttcagcaatcccataaaaagagtcagacgacggcctaagttccggccggagagacgtcagcacaccggatagaacaaaaatcacgataaggcttacgataaatagaaagatggcttttaccgctttccctccatttaccgcaacaacaatctgtctgtttctgcgtttatttctcattgaatccctccagcgcttgtctagtaattactctatgaacaagctagaggaagtagaactgtttagtgattgtaggagcctttgttttcttgtgacactttttcatgaagcgctgtgtttagtccgtttgctaaaacatttgccatatcgtcgataaatgaatcgacttccttcggcgtaaccattaagttgtgccctaaaggcgaaagcacctcgtgaatgagctgccgtttttcatcttcttgaagggttccgacaatccctaggaacgattggcgctgcttttgatcgggaagatcttcttcagtgagcactttctttttcccaaacgtcatgcctgccggaacaagcgatcttgatggcctgttatccttcatttctctgccaaaatgttttaatatgtagtccaccgtgtcgctggcaattgtcacggcatcaactactgtcggaacaccgatagcaatcaccggaacaccaagcgtgtctttgcttaaatcttttcgtttattccccactccagatcccgggtgaatgcctgtatccgatatttgaatggttgtgttgaccctttccaccgcccgcgccgccaacgcatcaatggcgatgacaaaatcaggcttcgattgctcaatcacacctttaataatgtcacttgtttcgattcctgttatccccattacacccggtgcaaatgcactgacaggcctgtaaccctcctgtacgttttccggctgaagcttaaacaagtgccttgttaccaacagattttctactgccatcggtccaagcgcatcaggtgtcacgttccagttgccgagcccaacgatcaaacagctcgcatcttttgagatattaaggttttcaagaaaagctgagaattcctccgcaaagacagcagagaccttctcctgcatttccgaatcattctccctgattccctgtgcttcaagcgttaaatagcgcccttctttttttcccgaaagctctgcgccttcctttgtaacatcaactgtgcggattttaatgccgccgtgatcacgctctttttcaataaagcctttaatttcttttgtcggcacagcctgctgattggccattgcttccttcgtttccactgccaaatcggtccgtatcaaatactgattcacatccagctcactctttttcatacaggggcctccttcacattaagtacctatattgttgccatttgctgaatgaatcatgctaaaaagagaaccttcaatgaaaaatactttacatttatattgcaatctaaaggtgtgtttgatagaatacaatttgttctattgtgaagaagatttaaccttaagacactgtgctacaggttgtatcttaggaggtgaaacacatgccaaacattaaatcagcgattaaacgtacaaaaacaaacaacgaacgccgcgttcataacgcgacaatcaaatctgctatgcgtactgcaatcaaacaagttgaagcttctgttgccaacaacgaagctgacaaagcgaaaactgctcttactgaagcagctaaacgtattgataaagcagtgaaaacaggtcttgtacacaaaaataccgcagctcgatacaaatcaagactagcgaaaaaagtgaacggactttctgcataatataaaaacgatcctcaataatggggatcgtttttttcatttctttttaacagctgtaaaaggaacagttcgagcagaagctgcttgtccttttttccggttttcatctcatagtccatgacggcaagctgttcaataattgaacggagctcctcctctgaaaaaagccttgcttgatccatcgccagctttacccgaaatgggtgaacttttagattagaagcgatttgtttttgtccgtatccctgttccgcgaagtactttgtctgcagaatcagccggaactggttcgaaataagcgccataattttgatcggttcttcattttgtttaagcaaatcataaaaaatttgcagactctcagttcgttttcggttgacgattttattgatcagctcaaaaatattttgttcaaggcttctagcaacaagcattttcacatcatccagcgtaatttcttcacgatctccaataaacgtgcagagcttttgaatctcctgaaaaatcgatgacagatgcccgttcacaagcagaaccaaatgctccgccgcttccgtgccgattgttttctgctctgtttttgcaaggttgacagtaaagtctgtcgtttcctttgcgtttaattccttcgcctccatcataaacgcgtgcttctttaacgctttcgtcagctttttccgctcatcaagcttttcatacggagcaagcaggacaaagactgtgtaaggcgcaggtgattgtatatatgattcaagcgcactgacgttgtgctcaattttttcttttttcttttcacctgttaaaaaatatggatttttcacaatgacaagacgccgctctcccataaacggaaacgtttcagcatctgcaatcgcttgatccagcgggtcctcttccagatcaaaaacggatagattgaaatcctttgtctcctgatcaacgaccgtctgtctgatcctgctgacggtttcttgcagcagatatgtctcttttccgtataagcaataaaccggatggacatctcctttttttaggcttttccacacatcaaataccattgttgtacgacttcctctctttcatcatccccctctatcctaaattgagtttgcaaaatagtaaagaggaagcctgactgctgcttccccatttatattaaacgcctgttcgcaagcccccgggacagcttgtaaaaaggcgataatcaccagaacagaaaacgttacctaagcttctagatttttcaaaacgattcgattatacttaaatcagtcaggagggataaagttgaatgattttgaaaaaaacgttcaaagcaaacgaaatgatgctgtagactcagctgttggttttgttgtgtccttcggatttttcgccttcttgtttgtcatggcaacggttattcacctggttggttcataacagcgactgcccgggctgctgatttctcggcagtctttttttagttcgtctctgttatatctgatgtatcatatggaggatagacagaaaaggttccaactctgtttttatatctatattggatcgttccgttttggtctgttcgcagcacgcggatagaatgtctctgtaatagttgcagaacttcttgatgaggatgatggtaccgattgtttttcccggctgagataatggccgttttcggctgaagctgttggatgaattcttcaccggtagagcctttgctcccatggtgccccacctttaacacatctgcttttatattcggaaacacgttcatcacctcttgttccccttctttctccagatcacccgtcaagatccagctcataccgcccgtctccatccaaagaacgagagatgaattatttttgcttgccggatcaggtgcttccggtgacagtacatggaactgcaaatcctttatttgcaacacatcgcctcgcttcacctcttcaatttccactccctcttccctggctgcctgcagcactttctcatctttaggttcagaaacgaaccctttcggaatcacgaggcgctttactttatgatacttcagcagaatctccgcctctccgatatgatcttggtcagcgtgcgtcagaattaaagcgtcaagctgcttgattcccttagcagttaaaaacggaatcagcaccttttcccccagtgaaaacggatgctgtttttcgcgccaaggctctgacgagtaagacaaagtgccgccggtatcaattaagacacgaccccgctgatgcggagcacctacaaacatgctgtcaccctgtccaatatctatcatatccacttctccttcggaactaagacacggatatataaagagcagaaacatcaccgtgcagcaaatgcctccggttaccatcaactgcgacaaggagcgtttttcaatcgccataagcaataggatgatcgtgaccgtgaataaaaaaagcaaaacaggtgcaggatgtgcgatcataatcgtgaacacttcaacatctgcaatgtttgtgattagcctattggtccagcttatcaataaatcaaaccagctgaaaaacaatctcccaaacgaagcggaaagacttaatagaagaacacctgctacagctcccggcaaaatacagaaggtataaaatggtaccatcaacatattcatcggtacgctgatgatagaaaactgatgaaaatgatataggagaatcggaagcgagcccagctgagcgatgagtgatacaattgtcagctgcctcaaagaggttttaacctgatgaaaaatagaagaggatagaattaaagaaaaactgacggcgaacgatagctgaaaaccggcttcaaagagatgataaggattgaagagcagaaggacgatgtatgaaagacaaattgcagttgcagagtggacacgccatttgacaaggcttccagctaagtaaacacccgacatgagagcggcgcgtagcactgaaggagcagcgccggtcaacatcacatagagcggcagaaataacagcaacagaattgacgccttttctcttgttataccaagacggatcatgatataaaacaaacctgctgtcaaaatccccacgtggagtcctgatatcgccaagagatggacaacaccaagcttttgatacgcggtaagcacttcgtcctccacataaaatctgtcaccgactgtaagtgcctgtacaattcctgccgaatcaggaggcagaaggctgtttgtgaatgatatgatatgttttctcaagctgagcaccttgtacttaaaattttcaggttcgctgcagttttggatagacgtgacagagtaattccaatgaatatgctgccgataaagatactcgttataatcaaatgcacccggcacagttgcgtgattcggttcttccaatgtaccagtcaactcacatgacattcctggttctatgtataacagctgttctttttcaccagcagactgaatgcgatacgcagcagcccatttttccttatcaggtgtcttaaccatcatagacatacggtcgccgtcaattttgggaatagtgtcaatcactgccttgaattgataggttccctgccgataggaagagacattctgagaatctgtgactgcatacagtacaaaaaacaatataaaagagaagaaacaaacaataataagaaaagcgtgcctcgttttgattaaaatgatgaggagaaagaggatgaaaagaaaaatagcggggaaataagcggcggcagtaattccagccgttgccgaagctgccgccataggcaataacaaacgcgaattacgcattcatcacacgtagctcgtgaaaagtgtattcgcctgttcatgtatctttttcaattcttcctccgctaaaccggcatcggccaatttccctataagacccgctacaaatgaaagcttttctctgtttttcagatcaacgatcatttcatcgagttcaacctgttcaacagttacacccgcctgttcaaataattcctgcgcatacggatgtgttttgtaatcctcagcataataaaccgttttgataccagcttgaataatagatttgcagcattgaatgcacggataatgcgtcacataaatctccgctccatcagtcggcaccccaaacttagagcattgaagaatcgcattcatttcagcgtgaatcgttcttgcgcaatgatcatctatcattaagcatccttcatctgcacaatgtacaccgcccgcgattgacccgttgtagcctcctgctatcatgcgtttgtctctgactatagtagcgccgacagataatctcggacatgtgctgcgcagcgccaataaatggctttgagccataaagtattgattccatgaaattcgttccacgttgttccctccaaatgttgtgttgcctgacctatagtttacctatcataatgcatgaccgtcaaatcactttactgtaatggaagactttattttctcaaataacttttcacctattcctgaaaccttagtgatttcttcaattgtttggaaacgcccgttttcttcccggtatgcaataatagcttcagctttggatggccccacccctgagatgccttgtaactcctctaaggttgctgtattgatattcaccagcgctcccttccctccatcgctttggacagaccctccgccaccttgctgcactgctgtttcctctccctttttcgggatgtacaccactgtcccgtcctgcaaaatctccgccaaatttacttgcgcttcgtctgcttgttcactggtcccgcccgctttctcaattgcctgagatactctgtcccctgttcgcatttcataaactccaggatgctgaacagcacctttgatgtctatcacaattgtttcgcttgactcgtcgttgtttgcttcctgctttaccactgtattttctgcctctgttggtacagcttgcttcaccggctctttatttttccctgtggccagaaagatcataatcgctgtgaaaacagccgcagaagccgctaaaacaattgctttcttatgctgattcaaccaattcatcgtgcatgttccccgctttcgtcatattttattttcataacacatatggtttagaggataatagctcaaaggaggggaaaccattgaagataggctttatcggcacaggaaatatgggtacgatccttatcgaatcatttattgaatcaaaagcggccgatccctcaaacatgacaatcacaaaccgcacaattgaaaaagcgttgcacataaaaaaccgctacaacagcatcaacgttaccgaaagtctcgaaaagctcgtttctgaaaatgagatgatttttatttgtgttaagccgcttgatatatatcctttactggcaagagcgctaccttatttaagaaaagatcatattctcatttcaattacaagccccgttcaaaccgaacagctcgaacaatatgtgccgtgtcaagtggcgcgagtgatcccaagtattacgaacagagcgctggcaggtgtttctctcgtcacgttcggcacaagctgcggcgaatctgcaaaaacgaaaatcaatgagctgatgcagcatatctctcatccgctgcaaattgaaagtgacatcacaagggttgcatcagacatcgtaagctgcggccccgcttttatgagctatctgattcagcggtttatagatgcagctgtcacggaaacatcagtatctaaacaggacgcgattttgatgtgtaaggaaatgcttgtcggaatgggaaaactgttagaaaccgaattgtataccctgcctgcattacaggaaaaggtttgcgttaaaggcggtgtaacaggagaaggcattaaagcgctggaaagcggtgtgcaggatatgtttcaccgggtatttcaaaatactcatatgaagtacgaggaggatatttctgcagtgaaaaagcagtttcatgtgtagacgagtatgtcatactttcgtctgtactgcaaaagcataaaaaagcattttaaaaaaccatcgttttaagaaacgatggtttttgatttctgcgccttgaaaaagaggcgttctgattgtgctgatggctcggtatccgtaaaatcagctgtcacgcgatggagctgaaagccgcagctcttaagcatttcttcgtattcttccaccgggaacgttctttgctcgtgtgtctcatcaaaacgatcatacgcttctccgttccacacaaaaaacgacatatcatgaatgacagaaagctcgtcacttccggcaaagctctgccaaatatagctgatatcttcgtcctggtcagcaaatgtgctatccggaaagacttccgcaattttaaaagatgaatgaacatcaaacagcagtatgccttcagactttaatacccgaaaaacactgttaaaggtttcgatcacatcattttttgtttttaaataatttaatgagtcacagcatatcacaacagcgtcaaactgaccatcaaagccggtaatctctctcatatcctgctgaagaaataaaataggctggctactcgataccttttgctgggcgaaagaaagcatctcttcgctgagatcgatgcctgtaacctcgaagcctttttcggcaagccggatggagatttcccccgtgccgcatgccagatcgagaatacggcctttttccgggagagatgcttcaatccaatttgtccattgatcgtaaggcgcgtgtgacattaactcgtcatacacacttgcaaagccttgataaatcattgattcattccaaggtcaagatctgcgagcggagcgtctccccacagcttttcaaggttgtagtagcttctttcgtccttgtggaagacatggacaatcacatcgcctagatcaacgagaacccatcttgcttcatcaaagccttccatctttttgacttgaatgccgttttcatcagcctgatccttgatttcacgggcaatcgcctgtacctgtttatctgaatttccgtgacagatcagaaaataatcagcaaccagagaaataccttccatatccagtgctaaaatatcctctgcccgtttatcgtcgcaagccgcagctgcgatctttaaaatggacttttggttcattcacaaattcctcctgttcagctgccagacacaagccagttatatgttaaaaatgtgtctggaaaaaccggttgattttttttcataagaaaaaccattgtatttttaatggactgaatcagcgcttgattcaaatctgtctcagcaagcttacgcacctcatcgacaccgggaaatgcccgatttggctcaatgtaatcggcaacgtaaatgactttttctaaaagtgtcatgccggggcgccctgaggtatgatacctaatggcgtcaagaatgtcttcatcttgaacccctgcctctctttggaccaaataagcgccgaccggagcgtgccagagctccggattatgatccaataaatgcgcaggcattttttctcgcgcaataatttgtttcatttcttctttcgggcggaatttggcgtaatcatgaaagattgccgctgtttccgcttttttagaatcggctccaaaacgctccgcaagttcgatcgccgtgttcatcacgccaaccgtatggatatatcggtgttcggtcaattgctgcttcacgcatgcaagtgcctcctcacgattcatataaaccattctcctctacatacttcttcactttatcagggattaagtagtcagtgggcttcttgcttttaaaccgttcccttatcatagttgatgatacctcaaattccggaacgtctgcaaagagaagcggataaggggtttcaacatgaaaaccggggcgctttactccaataaattgaatgaggttcagcagctcgtccagcttataccatttcggcaaatattcaatcatatcagcgccgataataaagaacagctgatcatttggataacgctgcttcagtaaagaaacggtatcaaaggtatatgacggtccttctctttccatttcaacaagctccagcttaaaggacggattagattgaattgcaagctttagcatttccacgcgatgaaagctgtcggtatagtcttcgttctgtttatgcggcggaatttgattaggcataaaccaaatttcatcaagccccgcctggtacagcacctcattcgccattaagaggtgaccattatgcggagggtcaaacgtgcctccgaaaattccgattttcttcatttcaaccacctttaaggaagctcgatttgtttattttcctttgattccttatataacacaatcgtattgccgattgtctgcaccaattgagagcggcttccttttacaagagcttccgctacatcgtttttatcctcttcgcaattctgaagcacgctgactttaatcagctctctcgcttcaagcgcctcagcaatttgtttaatcatgttgtcgtttactccgcctttacctacttgaaaaatcggcgttaaatgatgcgctttagaacgcaaaaaacgtttttgtttacctgttaacattctgttcctcctaattttcctattacaatggatctcattttttcaatatcaggctcttgtccagtccacaattggaaagacaatgctgcctgttcaacaaacatgcccacaccgtcgagtgttttcaagcctttttggcttgcttcctttaaaagggccgtctgtattggattatacacgatatcacatacgacggcactgctcgcggcacgctgtaatgaaagcggcacatcatccacgttcggatacatgcccacagacgttgtatggatgataacatcatactgctcaagacgttcttctgcttcttttatgcttaatacttctttattgtgaaacgagggagtagcttctgtaagccgctttgctttttctaacgtccggttgcaaatgtcaaattttttcggggtatttcggacaattgttgtaaaaatggctctcgccgctccgccagcgccgatcattaagaatgacagttcagagatgggcttgtctaataccttcattaatgacttcacgaagccttccccatcggtattgtatccgacaagcttatctccctctcttctgaccgtgtttacggcaccgatcacttttgcactctcatcaatatgatccagataatccataatggaaaccttgtgcggaacagtcacattgattccttgtacgcctagagctcttattccttttaccgcatcctccagatcatcctcttctaccttgaaggcatgataatgtccgtcaagcccgaggtctttcaatgatgcgttatgaatatcaggtgacatagaatggccaatcggatttccgataaccccgtacagctttttcatactcctctccccttttcttaaattaatgaacgccgaacaaatacatgaacgccttttggcgcgtatgcagttacctttttatcggcgtcatggacagtaacccagcctaacccagagaaaacgatatctgtctttttgtcttttatcgtaaacgtatgggcgaccaattccggaaactcatccatttcatctttacccggaggtgtgagcaattcccctgcatgcttttcataaagcgcgtctgcattttcaagttttgttctatgaatcatcagctcattcggcatatagcaaataaaaggagatctttccccagacacataatcaaaccttgcaagtccgccaaaatacagtgtttgctgatcattaagctggaatgtgcgaggcttcagctcctttttaggagataatattttcagatcctttttattgacataatgcgccatttgatggttgttgataattcccggtgtatcataaagcgatgaaccgtcatccagcgggatttcaatcgcatcaagggttgtgccaggaaattgggatgttgtaataatatcttcttcacctgacacttctttaataatccggttaataaaggttgactttcctacatttgtacatccgacaacatagacgtcttttccgttgcggtaatgctcaatcgcgtcaattacttctcttattccctggccgcgtcccgcactgaccaaaaatacgtcaaccggttttaagccaagctctttcgcttcacgcttcatccattggatcagacgctctcttttcagtgacttaggcaaaatatccgctttattgccaactaataagatagggtttccccccaccaagcgctgcagcccattaatccagctgccgttaaaatcaaaaatatcaacaatttttacgacaagagagtccgtttctccaataccgtgaagaatgttcaaaaaatcatcatcagttaaggagacatcttgtatttcattatagtttttcagtctgaagcaacgctggcaaatcacattttctttcgtaagcgatgcaggcggcgcgtaccccaaacctgttttgtcctcggtttggatcgtaactccgcacccgatacaaacaaccttttccatttcttactcctcccactgaatgtgcccttttcgtttgagagcactcagtattctgcgttcgacctggcggttaaagcgcgtaatgaatccgtcagaggaagcgactggcacgaccaaaatcgtatggtagccgtttcggtttcccccgagtacatcggtcagcagctggtctccgatgacaacgcagtcctcttttttcagctccatattgcgcaccgctctattaaaggctttacccatcggttttcttgctttatagatgaatgggattccaagcggttctgagaaaagtttcactcttctttcgttattattagagacaattgtcactttaatgccgtgttccttcatttcttcaaaccactcgatcaatcgcggcgtcgcattcggtctgtcccattcaacaagcgtattatccaggtcagtaataatcccttttacatttcgttcctttaatttctcaggtgtaatatgaaaaatattttttacaaactcgtcaggtaaaaaaaacttttttaacaaaacccgcacccttccctttttctatctttcaaaatgattgtcgaaaaaaatcgaacttgcgcctaaagaaaaactgagcaaaaaaatttcgacaaaaattgggtttcttcaccaggtgtggataaatttacacacactatccactcttattacatcactctttagacaaattataaacacgatactcacaagttatccactttttggtgtggataacagaacgattgttcttatatgcatttcatggtagattaaagataacttcaacctcagatgaacgcaacttatcattgtatgcgttaaaatcatgaatgattccaacttttaaggaggtgcctctcccattaattgggttcctagcatgagaaaactgtctgatgaattactaatagaatcttatttcaaagccaccgaaatgaatttaaaccgtgactttatcgagttaattgaaaacgaaataaaaagaagatcgctcggacatattatttccgtatcttcttaataggaatttgtctattttttccgggcgtatttcctttttttactcagatgactgatattatatcactttggctgcgcgctttactactattttcagcaaaaaacacccctaaaaagaggtgttttaaagggccggttattatgctaaccagtatatcccgcccacaaccaggagaacaacaactaaaacaacaataaaagcgtatccatatgctctgcctgcgccatacatgtgaagcgcctccttaataaggttttataacagcctatgtaggagaaataaatcggactaggcggttgtccggctcaacgctgcaggatctgcccatcttgtattccttcatatacgatccttgcccctttaggtgtcatatgatttccagaaggatctattaaaccagattggataagcgcttcatcagttgcttttccgccgtctgcttctataaaatgcttccagttatctacaagagggacatccaggcgcttcgacacatctcttgtaatatcgttatatgagttgtgccatttccttgctccgccttttggttcaaaagcagctgcttggtatctggaatagtaaaacagatgatgcttcccattaccttctataattgggatacacgtcattaagataggcttgatcccgtgttttctgctttcttcaataaaataaaccagattttctctaaaacgctgcttcgacactctcggcttcccttcagtcagtatggcagcgtcattggtgccgaacataataaacaaatacttcggtttttgatccagcacatctgtctgaaatcggagacgggcatcctctgtcgtctgtccgccgattcccgcattgagtatatcaaggttaccgcgctcagctgtttttaatatattgacccactgctgtgcttttggataatcgcgataatcccaatttgagccacgcgtattactgtcaccaaatgctacaacgtcttcgtatccccttccctcgcatcctgctgtaacgaacagcagaaggaaaaggatgataaaatgtttcatctttacacccccaaaagcctcactttaatgttatacctctgtttctcttcgttcaatgaagagtttttcgctatcactgttttttcctatagttaacgtgtccccctcagtgaatatcattctgctttcattgcggcgcagctgatgattttttaaaattcccttctttccaatctgaaaaacacacaaaccaaagaaaagaaaataacctgaatccgcactggaaacaggttatccgttaaatcctgcatttactttaacttcgatttaagcttggcctttgtttttggcccataaatcccgtctgcagttaatccgttcatgagttgaaaacgcttgacggcattcgctgttttcggtccgtaaactccatctatgccattgtttttggctcccttatcagggtaaaagtgaagtgcagctaaagccttttgcagctggagaatgtttgtgccctttcgataaggcgaagtgagctttataaccccagacggcagaggatatgatggtgaagattcttttggaggtgtatccgaggaagaaattccgtttagaaaagagttccagtggtccaagagtttccgcggacattctttcccggaccattttttgtggggaacaacacgatttaacggaatattgttttccttcatcagctttctgatcagccactgggcatttgatgttgctttttcaaaatcgccgtcagcattttcacagatttcaatcccgatcgatttgcggtttcctgtcccgtttgtaccgtctcccgcatgccagccgttttcatctatcgggagatgctgataaatgactgaatcgtcaactgtaaaatgccagctttcggatgtgttcgggtttttcacaaacttggcgtgcattttcgcatcagcgccttttgctgtattcgctgtattatgcaccgtaatataagcaggcgtcatcgcatagccaggacgattatcatttgataccggtataaaatccttttttatggttaccatttctatccctccctattattaagaatgcagaaaacagagagctggacagccttttttatgaagtaaaaaagaattgtgttctcaacctggttttcagttgaaccgctgaaatggcaccagttatactaatttagatgacggaggtttttgctcctgacatcacctaagttgggagtgaccatagacatgttaaaaaaagtaataggtatacttgtgattatcgctatcattgcagtcggtttttttcagaaagaagcttggcttgatgcaatcaaagcaggagggatgttttccgttttatttagtatgctgctgattgctgccgatgtttttttcccaatagtgccgtttgctttggttgctgctttaaatggcgcagtgttcgggactgcaaatggaatttggattacactgaccggctcaatgcttggtacaatattgctgttttttctcgctaggtacagttttagagattgggccagaaaaaaagttcaggcctaccctgccatacaaagctacgaggcttccttcaacaaaaacgcttttaccgctgttttattaggaaggctgatacctgtcataccttcccttataatgaatgtgatctgcggtctgagccaagttcgctggcatgtttttttctttgcgtctttaatagggaaaatccccaatattgttgttgtcactattgcaggcgccaatttcaccagcaataaattattgtctatcagcatttacggtacatatattctgatcatcatgctggtcatttataaaaagttccctcatcttctaaaggtgccaaaaaaataaggaggcttgtttggcccccttactttttttctgtcgcatggcccccaaattcatttcgaagcgcagcgaccacctttcctgtaaacgtatcgtctgttaaagaacggtatctcatcatcagtgacatggcgatgaccggagttgccgtctgcagatcaagcgcggtttccaccgtccattttccttcacctgaggaatgcataatgcccttgatctgatccagtttcgcatccttagagaaagctcgctcagtcagtcccataagccaagaacgaatgacagaaccatgattccacactctggcaaccttctcatagtcaaaatcaaattggctgttttcaagcacttcaaatccttcaccaatcgcggccatcattccatactcaattccattatggatcatttttaaaaaatgtccgcttcccgcttcaccagcgtatagataaccattttcgacggcggtatcacgaaaaagcggttccacaatctcccatgcttcatggtcgccccccaccataaaacaggctccatgccgtgcgccttccattccgcctgacgttccggcatcgagataatggatacccgcttctttcatttgattgtagcggcgaattgattctttataatgagagtttccagcttcgataatcatatcgcctttacttaataaaggtgatacatcacgcaaaacagcatcgacaatgctatgcggtaccataacccataggatacgcggcgggtctaataaagaaattaactctttaagattcgttgtcccctcagccccgtatgctttcagttcatcaacagccgcttgatttacatcatatcctaccgcttgatgattgcggtcaatgaattgctttcctatgtttatgcccattttccctaagccgattaatccgattttcatatctgttcctcctgattgtctaaaaagcctttactctttatgttccctttggattgtattgtgatacgcagaaaacaaatggggcttacatcgtctgcgcatgtaaattttatttttcatgaccgacggcgcctgccagttctattactgaatctctttatatccataattatcgctttatccttgatttaccatcagtttaagttaaaatatgggaaggaattcgattttttcagtaaaaagaaggtgacatgttgcagaatcaatctcatactcttattggagttacgaaaaccgctgtattctttttatacgctgcacttgcaatcatcggttttgcaatcgggtattttatcccgcagattgcgaaatgggcattatccctcccctggatccctcttgaaggaccgcttcggctcgttacctcttttcagggatctacagctgcatttatcactgctcttctcggtatgtgtgcggggatttggttcgctcattctgttattgcaatgctgctgtctgtcaaaattacagatcacacagtggaattcatcaaaggaaaaaaagtgcaaacaattcattccgatgacatcgctcttgtatttatggatcacaaacggcttgtcctcctgggaacagccggatatgaattggtacgggaagaaattgatgaaaaaccagtaaacgttgagaaggcctttagacagcatcattacgaatgggcagcagatggtgatccgtttaaagatcaatttcgccgatggattcctgatgcaccagacctatcgcaaggcgcccatgccttattaaaagctcgtcataaagcgctgcaggacgaagaaaaagacgatattgaagaattccgtctcgaactggcacagctgggcatcgttgtacgggacgaaggcacacgccaatattggcgaaaagcagaaacctatcccccgaaaattcagcacggcgaaggattgtaacaacagaggctcaagaaagagcctcttctttactactgcacaataaacagcactctggtgccgtcaggatagctgctcatttgattccctacccacgagccggcgccgcgattatcagaaggcgtcacatatcggacatcagcccctgcgccgccttcctcgcagaccgccatcggccactcatcccggtcatagcccggcttggtcgggattccctttaaagattcctcccgccttttgtctgctccatctctgtcaatggtacaaatatctggatgtccctctgcaatcgcatctctaatatgactgccggtttccggataacgagacagcggaaaatataacactttgtcatacgaagatgcgccttggatctgttgcggaaccattaaacaaagaagaactgctgcagcaagaaacaggcctgccatccattttttcattcccatccccccatacctttgttcatttcaatgtatgggcgcttgataaagattatttttaacatttgaagttagtatgctgcttacaaaagccggactcccccgcgagaaatttcccggtacagacacagacagcctccaggtcacatacatttacatataggcttttgcctacatacttttgtggaggtgacgatggtgacaggtgttttcgcagcgctcggctttgttgttaaagagcttgtctttttagtatcttacgtgaaaaacaatgcctttccacaaccgctctcaagcagcgaagaaaaaaaatacttagagctcatggctaaaggggatgaacatgccagaaacatgctgattgagcataatcttcgcttggtcgcccatattgtgaaaaagttcgaaaatacaggtgaggatgcagaggacttaatctccatcggaacgatcgggttgataaaaggaattgaaagctattccgctggtaaagggacaaagctggcgacgtatgctgcgaggtgtattgaaaatgagattgtaattacaaaaggggggtgcatacacccctctttaatacgtttcaatatatatggtgtcagaatccacaatggtaacttctttcacgataaagttaacaattgtttttttatcttcaagagttaagttatctgcaccgattgattgaaaatagtcgatggctctttttagagcattttcacttgagctcgtatcatctaggactttcatttttgactggatttcgttacacttttcagtaagctgattttgctttttttgcagttcaataatttgtgctttgatttcatctatgtctaaatcatcgtcatcgcttaggctgattagcgttaaaagacgcttgcggcctttttttgttttctctatctctttttcaataagttctaattcatcagacaggtgatttgattgttcagcctctttaaaagaaacatacttttgaggatttgtgatgaatttaaaaatttcaccccatacatgccggttcaatttattctcagacatttcttttccgcagccgcggtcctttgcgccagaataatttttccggcaagtatatacatagtagtctttaccatgtgattttcttttcttccctgtcatggtatttccgcattttccgcatctaaccaaacccgataacaagtaattgtgagggctgatactcaagtgttttcttttactttgacctaagagttcttgagcataatcccattgttcagctggaacaattgctggaattgtcacagtgatttgttcttcttcaggccttattttaattatagatttgttccctgcctgctttgaaacataggaaccctctgtatcatatttatactgtctatgttcacccttataggaagagttcattaatatttgccgaacaacctgcctgtgccatactttggcgcctttttttgttttaacccccatctgagttaaatgtagagcaataccatttactctgccgaaaaaagggcttttatgatcggtgaaatagttaaaaatcatccgaatgatttttgcttcctcttctaatatctcaagagttcttttctctttaacaaatttatagccatatagtttagaatctttaatgatcatgccttttttcattttttgaagtcggccgcttgatgtccgttctttgattttggctttttcaaattctgagattgccccgcgcattgcgaaaaacaattgaccttctggagaattggcgtattcaccatttacaaaaatcaaaggtatgtttcgctttcgcaattcgtcatcaatgattagctgattcattaatttccgagaaagacggtcaggatcgtaacaaatgacttgacttataagtcccttgcttgcatcctccctcaagcgattcaaagccggacgttctaaaagctctcctgaaaatccttcatctgcatacttcagcacatctttagtccctgctttctttatacaggcctcgatttggctgtcgatgctcgatcccttgatcgcttgttcctcggtcgatacccttacatatattgctatcaccctgaatctccttcctataaagttttattaaataatgatagcaatcgttaatgcatttgtcagcttgcggtccctcgatgattatcactttcataaaatgcatcaccccttgggtaatgctatgtaacagctgtttgtccaaatgaggagattttaaattaaactatagtgttattaaacgtttcaatgaatatgcaaaaaatttaaaaaaagttgttgtgacttttctacactcctttaggtcctcaatagaaaagattttattttctatgcctcaacattcgcttattatagttttcaatgatttattattatttgagagtacaatggagtagtgtttttcattgttagatagttaatgacatttcactggtgtcaagttcgtatagctagacattaataaaaaaaggacacatataaatatgcatcctttaacaaaagagtttatttatttccctgtttcagcaaattccttcaacctattccctatttcatcacgaactctttggaaaaacgcccatttttcttcttctgtcccttgtgctcttgccggatcatcaaaaccccaatgctcacgttttacatgtggaggcgtcatcgggcatttatcagcagcatctccacaaagcgtaacaactaaatcagcattgttcagaatatcagaatcgattatatctgacgtttgattagagatatctataccaacttccttcatcgctttaacagcattcggatttaatccatgtgcttctatccccgcgctatacactttccactcatcacctaaatattgtttagcccatccttcagccatttggctccggcaagagttccctgtacataaaaagtaaatgattttattctccatatattccacctctacatcgagtgacttccaaagtattttcgttgaaaccataaagcaaccttaacaagtgctatcatgactggcacttctacaagcggaccaattacggcggcaaatgctgcacccgaatgaattccaaatacaccaacagctacagcaatcgctaattcaaagttattgcttcctgctgtaaaagctaaagtagtagttacagcatagtttgccccgattttcttccctaaaaagaaggaaacaaagaacattaaaacaaagtaaatcaataatggaatcgcaactcggacaacatctaacggcaagctaacaattacatcaccttttaaggaaaacatgacgataattgtaaatagcaaagcaattaacgtaattggactaatcttaggaatgaacactttttcataccattctttgcccttcacttttacaaaaatataacgtgtcaccattcctgcaataaaaggaactccaaggtaaatgaatactgattttgcgacttctgccatcgtaatattcactactgctccttccatccctaaccattgcggaataactgttacaaaaatgtaagcataaactgagaaaaaaagcatttggaaaattgagttgaaggcaactaatcctgccgcgtattccgtatcaccttttgataagtcattccaaacaataaccatcgcaatacagcgagctaatccaatcataataagcccaatcatatactccggtttatctggcaaaaagatgatagccaaaataaacatgagagtcggtccgatgatccagttttgcactaaagataaaattaacactttaatatctttaaatacccgtccaatttcttcatatcgaacctttgctagtggtggatacatcattaatactaatccaatagctaaagggatagatgtagttcctacttggaatttgtttaatctaccaacaaaactcggaaatataaaacctaatcctatccccaatgccatcgcaagaaaaatccagatggttaaataacggtctaaaaaagataaacgtttcattactttatcctcaccttttttactaacagcaagagttcgttgtactatcacttggtggtgctacacaacaagaggaagaatcttgtttttgaatctcgctattcgatttggtatagaaaaattcccactcgtttccatctggatcagtaatccaaaatttatcttggactgcataacaacaagtcgtatccatttcctcacgtgcaaaaaacccttctttttcaagcctttccttgtgtttcaaaacttcttccaaactatctacttggaatccaaaatgattcacttgatttcccttcacctcatctgcgacatttaaagtgaagttcagtccaggagtctctaataaaaactttgcatagtctgtttttacttttacagcctttactccaaaaactttttcataaaaactgatcgaattctctaagttgacaacgttaatccctacatgaacatatttcattttaattccccctcttatctattaatcaaaaaaaattgatttaatgcctaaattttttttagcaacaatctccttcacctttttttctaaatacacaacaaagctcttctgataataaaccatttacttcctcatcatttagatcataataactccatgttccctttgtctctttcgttattaagttggcatccaataaaatttttagatgataagaaagtttagattgcgtcacctcaaaaatctcagtcagatcacaaacacaggtttttcccctttgacaaagttcatacatgatctctaatcgtttctgatcagcaagagccttaaatttttgttcatatttccgtagcagttctgatttcgtctcatccattcatatcgccttctttaatcaattttttttgatgtatttattatactcatgatttttaaattaatgcaagcaaataaatcaatttattttgattaattgtaaaacccgctaaaagcttgtgtaaccagatagaggttttccatttttattatttcctccatcgctactttgctactacagcaacggagatcataaacgctaatttctaatttcaagaaaaaaacattaaatctaatttttgtgaatatgtagaatcgataataattcgagataatacgtatttagtcagagcacacagatttatcatcaattaaaaccttatgtgaagatataagccattcaatccatccttccacataaggttttaaacaatttaatcagaccttttctttttgaataagttcttcattttcataaaagggcattgtgacacttgattttcatcatctcgcaagaagtactgtttccactccagattgtctttttttccataccatcctaaatgcggatggataggtacttcatcatatgcctcaagcctttttcgaatttgcttactcatatttcgtccaaatgcagtagtatcatttagatcctcaaaaacccatctaggctgaaacgtcaacataaaataaggaaaacttctgctttttcttttgctgtgagctggtgtagcacacagaacaaaatatggttctccattaaaacagtattcccattgaaagtgctctggattttctggtatataatctggccaatcagctggatcttccatgctcaatgaatttagaaactgccaaaacaacgattcgtaatcctcaattttgtaatcactaagcaagtcttctggtgtatgaaatattatagttaatgatgcatactttcctgtctctcgtgaaatagttccataccgagtaagcaacggcgctaattccttcgcagttctaggattcctaggatcaccgacaaaagcaatccgcagctggtcgcttaaaaatgctacccttcccggtatacaaggaaatttattttctttatcgcctattttttccgttaagtagttaaacgacttcatttgccaatcaggtaacgtttctttaattttttcaagatcacttttggcatataactcagtcaaaaaatccacctccaaaggcatttatcataatgtattgcgggagcaagaaggcggtgaatgtctaattactttttcatatatccaaatgaatattaattaattaattggttaagttttagtgggtaggtaagtaattttcttatcaagaaaaatccagaatcagttctgcgtttagctgtacatgcacactcagccctcaaaacgactaacgctggactttctggatgttttcaattttaaactatcacaagaatgaccgaaattccctgttttttgatgccaagtcatggtactcccaggagggaatttcataactctctaaagcaaaaagttattgcggtctcaccgaaaatttaaattgcggtgccctatttcctttttctgcgaacgaaaacttgttaatatttacagtactagtagagttaagggaagggtgaatatcttgatatcaatcacatcagctgaagtgggaatgaagattaatgaatggcataggcatattcaaaaattcaacgtaactgatgctgaaatgttaaaagctgaaatagaacgtgatatagaggttatggaagaagatcaagacttgcttatttattatcaactaatggcctttcgccataaaattatgttggaatacacgctgccatctgatgaaaaccgaatggaactttcagaatatttaaataaaattgagggccataagaaaaaattagacaatatgcgggcatattattataacttcttccgcgggatgtatgagtttagaaacggtgaatacacaagagccattacatattacaaaaaagctgaacgcaaaattcctacaatctccgacaagattgaaaaagctgagttttattttaaactgtctgaagtctattatcatatgaaaatgacacacatttcgatgcattacgctgagctttcatacaacatttataagaaacacgagctttactctgttcgtcgtattcagtgccattttgtcattgccggtaactacgatgaccttgaaaatcatgaaaaagctctcccccaccttcaagaagctttaaaaggtgccgagctgcttaaaagtaaaaatactcatatctatgccactgcgtttttcaatctcggcaattgctatcacaaaatggacaacttaaataaggctgctcgttacatcgaacaagccttggttcaatacagaaaaattaactctgacgtacttccgcaagcttatcatgacctagcgttgatttattttaaacaaggcaaaaaagaacaagcaatggattgcttccgcaaaggaatcggaagtgctgtagattttaaagacgaactatttatgaacttatttgaagcattagacgttctttatataagaaatggcgatacacctaaacttctcaacattttttctcgtttagagaacggcaaaggatacccttatctggaagagctggcattgttaggaggcaaccttttcgattataatggaaaaatagaggatagtatcatctgtttcaagaagatggtatatgctcaaaagcaaatatcgaaaggggaatgcatgtatgaaatctaaattgtttatcagtttatccgccgttttaattggacttgcctttttcggatctatgtataatggcgaaatgaaggaagcatcccggaatgtaactctcgcacctactcatgaattccttgtttaattcgataaacaacattagttctgattccctttagccgtttcataacggctttttcttatttctaatactgaaaaaatctatcatacttaaagcttttgaggtgaacattttggacttatttgatgaatgcttagaagctctagggaaaaacaaagaaatcttatcagaagaattaacggcaaaatattatgaactgctttcaaacagttttcccttacatcttggggacgaatcaagtgggaagaagtttgttgtcatcaatctatagattacgaggaagagatttacgattggctagctaaacaccattttaaagataggaacattattattctttggggttacggagaacagccagcattaaaaaccagtcttgagcatgcattaaacgtaattgatgatgtaactgccgttggatcggatacttttatgtttagtgaatctggctacgttatcgaattttttcatgatggcgatgttacaattggaaagtcccctttcattgaaaggattaacaaataggtaaaatgacacagatcgaatgattcatttccaccatttgatccacataacagttagtttcatcattcttccatggtaatattttgttatgacgattaaatgaaaggatatgatcatgaaagtatttgaagccaaaaccttgctcaccgaggctgaaaagcgagcacaggaatacaaagatttaaaaagtaaaatggtcaaattaaagaaagcgttcaaagctgttgcagatttagatgatagcgagttttcaggcaaaggcgccaataacattaaatctttttatgaagatcaagccggcattgctgatcaatggattgatttaattgaaatgaaaattgcttttttaacgagtattcctggtatcttggaagacgccaacttatctgatgcctacatagaagaatcctttttagaacatgaacttgctaacgcctataccaaatcaaaatccattatgtctgaacagaaaaaagccatgaaagatatattaaatgatatcaacgatatactgcctttggatctgttctcgacagaaacttttaaaaatgaactttcgtctgccgaaaagaaacgaaaagaagccattgagaaaatggatgaagttgaccaaaacttaacatcagaatacggactatcagaagcaaatgaacaaatgattcaagctgattaccaagctctaataaatgcaacagcaaaaggcaagagtgcctctcctatccactataacgcaaaggcttatagagatagtgaaattcacaagatgactgagaatgtaaaaaaacaatcgactgattatatcgcctttaaagatcagcaggccgaacaaagaagaattgcaaaagaacaagaagaactggcgaacagaccatggtatgaaaagtcttgggatgctgtttgtaattttacaggagaggtctctggatattatgattataaaagagccgctgatggagttgatcctgttaccggcgaaaagctgacagatggccaacgtgtagcagctggagcgatggctgcggcaggttatgtcccgattgttggatgggctggaaaattagcaaaaggcggaaaagctgtttattcaaccagtaaagcactctatagagcagacaaagctctcgatgtatataaaacacctaagacattccatgcccttcaaaactccagcaaaggactttatggacttgcttctgcaaatggttttagtgaagctataacaggacgcgatatgttcgggaataaagtctccaaagagaggcaagaacagagccttagtggtgcaatggcaatgttggttcctttcggagctcgcggaattaacaaaaagcttaatgcaaaatcaagttctcgagttagcgaagcatcgactaacaccagcaaaaaacctaaagttcctaaaacgtacaaaagaccaacttatttccgtaaaggcgttagagataaggtttgggaaaatgctaaggattcaaccggatctgttaaagacccgttaacaaaacaagtaatgaaaaaagatgaaccatgggatatgggtcataaaccaggttatgaatttagaaaacatcaacaaagtgcgatggaaagaaatattagtcgaaagcaatttttagatgaacataataatccagaccactatcaacccgaattaccttcctccaataggagtcataaaggggaagatatgacggatgattactttggagattaaggagagattgtctaatgggcgtaacacaagaaaataaagtaattgctagaacagttttaggagcttttggggggaaaccgaaggttacgaaatattgggatgataacaagaatagcagcatagatattttatcggttagtgaccagcctcaggaaggtatcacgtcatattcaactctaggtttgtcggatcattctattaattatgaggtgaatggtactccgttgcgggtagaaatcgtagctgcaatggagtcagcttcagacatatatgctaatgttttatcaacttgtgcctttaatataatcaactcaaatttctcttgtgcaccaggtgttatttttaaagatgtgattagtatgtatgatcaggaaaccgacatgaaacatgttatgttcgttcccccatttctgtgggaggaagatttagagctacttgaatttagcaacaaaaatgttacttggctaatggctttacctatttcagaaggagagttacaagtagctgaacaacacggtccagaccatttacaagatctcttggaatcaaagcagattgatatttttgatataaaaagagaatccgttgcttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggcttctaattttgcttttgttttcggtccgtagataccatctgcagaaagcccgtgcatcagctggaaccgtttgaccgcgtttgctgttttcggaccatacacgccgtcaatgccgttattcttcgctcctttgtctgggtagaaataaagagccgccagcgctttctgaatctgtgttacagacgcgcctttcatcattggacttttcactttatagatgccagaaggcagcgcatatgacgttttctttttgcttgagcttgttgttgtctttttggttgcgtttgttttgcttgagcttgttttcccgcctagtgacttcaattctttttcaatggcagccttaacctcattccatctaccctctgacaaaatacggtgcgggcaatacttgccgttccagtcttgatgcttgcggacacgatcaataccccaaccgcgttctttaaggagctgcgccacaaatttaatagccagtttttctgctgccttatatcgtgcccctcctgacttgctataacaaatttcgacaccaatcgacttacgattccctgtaccgtttgttccatctcctgtgtgccaagcgttacgattcgttggaatcccttgaatgacttgtttatcgtctactgcaaagtgaaaactcgttgagctagagttattcttcatgtaagaaatctcattggctgctgaagcatcatttgcagtgttatgaatagtgatatattcagctttcattggattaggacatttcaatccatactttgatttagagactaaattctttacaactttaatggccatatatcctctctccttctgtctgtgtaataaaaaaagccactggcttagccagcagctttgtctgcgttattcttactctgttctttttcgttctcaattgtttgtaatcgatctgttattgatgatggaatcttaacaccgatctgtgctaggttctccgtaatggaaagcccctcatttgcgatataaaaaagaacggttccaaatgtcaggacaccgttcaaattgaggattgtatctatgatgtttgccacaatgaccaccaaaaaactcagcatcttacgcacataaccgaaccaagcgctccggctccggagctttttgaatttccatgccttgatcacgcccgttattacgtcgagaatactgagaactagcagtaaatcaaggtacttcacacccccaaacaggtaaactctcgctaaatccaacgtttcaaggttaatgaacacagtcgtttcctccatttctaatcacctcctccgaggcaaataaaaaaggacagccggatcttatgagacggccgtccctctaactgaaaagtttccatttgttaaagctgtaagctccataacaatttctttaaaaccagtaatgttaaaagaccaagcttctgatttcccttttgtgctagtggcaaatgttccgtcatccactttctgccctctaagggctctttttgtccccgataaggatttaccccagaacttcaattcacttgtctcagccgtcccataaacctcaatgagcaacgttttgaatgatccaacggtgaatgggttaccctcacctatgttttctgttttatcgtgaaagacaatatccatcgtttttgattgagtgtccaaagatctaaggttcaggccttcagtctgaacttttaaacgaccatcatcagttaagctgcttttatctaactggactgagaacggagcaactgctgtaattggaacagtgtggttaatggttatatcctcttcacctgcgcccaatgactggtaaagtaagaattcagattgttgtaggttaccatttacatatctgaaacggaaatagcgtttagttaaatgaatccattcagtctcgccaagtgtatttgctttaacaaccaacgaagagactgtggtccatgaattcatatcgttactttcttcaatgaataaggtaccttcacgatcagaataagcatgaccttttacttttgaaattaaaatctgacctaatcgatcttggccatattgcgtgtacacttcggtcgcttttaagactgcgtttgtcagcagctccgcattacctgaaatagtagccacaggtactataaaatcatggttcccttctctgtacggtttagccgctcctggcttacccgttgcatctgttgggaattgaaaactatatgatgccatagaaaatcctccttgctattgttgatctttagtgatgagcatgggttttacaacggcaccacccccttttaggcaaaataaaaaagccctaaatggcttctcctgtgatctctttatactgttcagctgtaatgagttttttctctacccctttttgtaaatcctcagtcgagcaatctttataatggattgcctttttcaccatttcagaagaagcccagttataatgcaaagccagcacccaataattcatgaaccttgccctccttgtagagtaagcagttgcaactttatttttgaaagctcgcttcccaaagtttggtttaattcttcaagctgtttacgagccagtttttcctgtgacaactctcttgcaagtagatccacttgaactggtggttcatatgcagatgtactctgaagctcttcccaccaagtttttaactctgcttccgtgggtataggtgccctaatattccactctgctatatatgagggagttccgtcaccattattctggacaataaaatcctttgtgggatcagctgttgggtatttaaaaagaatagcttcacctatattcatcgttacctcctaaaatcttggataatttctcccgcctaattcctgtatgtcaataaagttaaacgatccatccttatcgtccacgcccctttgaccatttcctacgtaattacaataacaccagatttctaagtaatcacctttgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattccatcattcggaacaataaatctattgtttttagtatcaaaagtattatggctatccttgattattctattgaaagctattttagtatggtcaactttttttaagtattgaatgcctgtagttcccacatttgcatgagcaaaacccgatattttctcccattttgtccagcctgaaccactccaccagtgtctaatccaaactcctgtactgtcatagtaagtcccagactcattccctgttccgtaaaagtattgagtgaaacggtaattattatatttttcatttttgacaatgccataacccaaggggtagcctgtagtatttccctgcccaatgtccattaaggtcagtcctaaaggatattcttcccctcctgttcttgcatcttgaatagcattgtctccagtaattaacgtcagattgttatttttatagttggtatccacgtaatattttgcatccgataaagccttatccgctttttcctgagctccgacaattgtttcttttgcattccaattctcccgttccactggtgtaatgtgccgttgtaaatcattacgatgctcttcaaattcttttttcgaagcttgctgtacattatcaacgttccctagcccgatttgcgcctttgttgtattgtgagggttgttcatgtcatttttatgtacagctaaatctttatgcgcatcttgaatgcctttctcccaacggttcacatcatcttcattaatcggatcgtccgggagccaatctgtttttgcatcataagccatttgctacaccacctcgaaagtaatcctaaaatctagcgttctattattactgacgtctaaatctgttgttctttccgtaattacgttgttttgttcatcaaggatctgcacactcttaatatgtttgatatcttcctctcgttgagtaagtaccgtgacaaccgcaccgtgaatggtgagttccacaatttctgtttcactcccattcagtagcactttcgatatcctatttttcaaatctgcagctgtacgctctctataaacctgcgtaatcatgcaaggaccacctcgttattattgagcgtgacggaataacctacctttagctcacttgcttttcgataccttctgttattcaaaatgacagtatcttttatcttgagtggctcattcacagcagctcgcaaggtatatgccaaatgagctggcttcatattctccaatgtttctatgagctcgctcatatgctgcatatcatctatatcaatatcaacattaaaacggtactgtccttgaagcagcctgacctgagcagacggatttttcaggaaccggttcaatgcctgttcaatggccttatatgttgccggcggtatattggacattttagagattagacgcaatcggcggatctcatcggggtcacctgattcccgcggtacgttcaaaatcttttcccatcgttcaagcccccaggttgccgtagtaacaaacaactgatctgtcagatcaaagatgctattattttgcttttcaaattccggagcttctgcctgaagaagttccgccatttctttcaatttggtaaggaacggcggcaggtaagcagtcatttcatcgagtttgctcaatgatgttcacctgccccaatttagggatttccacgtcactcagaaccaaattttcggtcacgccgttgattttaatatctgcgtaatcacttactgaaggtgaattgtagacgatattattaatctgcgataaacggatgacgttatcttcaaaggcaatctttttaaaaagatttaaaacacctgattcaatttcttgctttacctgatcgatagagctattgacctcgggaaatacctcggctgaaatctcaacctctttccatatcgcactctccactgtgacaaaggcacctattggcgcttgtccctcaccttgtccgggttcaggatcaatatagtttttcacctttgatattaaaatatcggaagcaggttccaagttagcattggtcacgacaattttgactgtaccgtccccgttccaaagcggaaagacctttaccttccctactccgtctacttcttcagcccattgtttatagtgagctttattggcactgacagcttcccgacgcacgcgggtaaaatatctagctcttaaactgtcatcatcctcctcttctcgaccagggattagaatctctttcacgatcgctttttggagtcctggtatggtgtctaatgacaatagattctggccggaaatatttgcgttccccgcttcccccgctgtttcacattccaacgtcccgtcagctgtgtattggaaatacaggttatctacaaaaaagcgggaacccactggaatggttactccttcagtaaactccgctgcccggactgctttcgtggcagccgttcgctcgatgccggcttcagtagcccgacgatctaaaaattctccttgtgctgtgtccgagaagacaagttccagcaccgtatcgagccaaatataagacttggccaattctgcggctgcaggagctaacgcgttataaatcacgcttccttcccttgtatcaatgtccgctgaaattctgttcagcatccggtccataatttcttcaaaagtttgatcttcaaacatcttcaccaagcacctcctcgatctccaattttccctcgtccgtttcgactgtaaaggaaacatggaacgaatcaccttgtttttctatttcaaaatctgatacagaggaaacacgatcgtcatagatcagcgcttcctctattagccgcggaatctccattttcttatatgcgtctgttgtttcattatccgccaagatgtcttgaagctcatttccaatgtcatggctgaaaacagaataggcgtatcgctcagtatgaagagataaatatacaaactgcctgattgcttcaaggccagtaatcatttcatttgtgatacggccattttcaaaatctattttgtaggtttgcgaggtttctatgacttcgctgtcatcttctatatcctcaaactcgatttccggagacaaagccattccaaacacctcctatattttgtcgagaataaaaaatgattgcccgccttttaaggagacaatcatcacacgctcaccagtattcaacgcttcttcttcaccgggccgcagccgctttggaacaataatcaaatcagcaggtattattaatttgtcattttcattaagccttatttcaacaggagaaacggaaaccacttcagccggcataatatccactggtgactcagaatcaactgcaccgacagccaaatgtttgattgcttcacttaatctcatgaggaaacaccatcagggatagaatttttctcaaccacatcaatggtcatcgtgtgtgtcgatcctttaaattcgtgtttatctgtttcaatccagtatgttttcttaaccccgacttccggaattgaaatatagacgggcaaaccactctgaagatctggaatcccaattgcttgaatacttttgagttcttttttgacgcctttcttctgtgcctgtttaactttcgcacgctgctgcaactgtgcttggttaatgttatctgatactgtttcaacatactgaaggacgccgtatttgtttatgcctgcgctgtcgcttgcggtggccgtgtatgttttattgtctttctgacgccgcagctttactcttgtgactgtgtcattaatggaagtgctgtattgataaccagtaatgttcacacccgtttccagtacccatacttctgacggatcaggccaagcgcgaaggccaagcttccccttcgcagaatataattgataattccttccggtttggcttttcgtttgtttcaaagctttcagaatcatgtcataaaggctcgtatcatctttaaacactaatgatttaatggtgtaacccgtatttgcaatggatgtcgttggaatttgaaaatctcttgccaggcgcttaataatctcgtctgcacgcttattggagaacacataaacatctttgttcttaaccagatattgcagcatgtcataagccgtaaaggtcagcccatgttcttccggattgcgagaaaacacaatacctcgaaacagctctttccctttccacttaaacagaaccgtatctccttctgatacgctgtaatatgaatgggttccttgtttcgttatgatctttgctgtgattgatcgcggagcctgataccgttgtccctcaagagaaacactttctgttaccagctcaagccattccgtttctttaatgacgaaaagttctatcatgtcatcacctgcttactgcggtatctttaatttttgcccaggaaagatccagtgtcctggctgcctgatattacgtttacttcgtttgatcatagcctttttattgacgttccagattttgcgccactttgtgctgtctccataaaatttaccggcaaggtcccacagtgtatcgcctttcttaacggtgtatgttttaggagctgatttagatggtcgtttcttcttcgtctttttcttctgcttgatcttccgcggcgaagcagttttgtattccttcagctttatttcataatcacgatcacctatatctttttggccctcgctatatgaaaaaacctcgatactgcaagttaaattaattttcgttccagtaattaagaattgaaccggctttttagctttcacccatttctcgatctttgcaatagcattttcaggagaaggaaatcccttatactcagcaagcgggctatgtttctttggaaaaaaagaagaaaatgaaatttctttcgctcccggtttatcaataaacgtgatctccccaaaactagccacttttactgattcattttgaattgtgtttgaaatatcaatttgttcaggaaggacaggaagccgtagcttatccttcccttgtgaaatccagaattcatatatggatttagtcaaaagcaacgactcccttcgttccaatgttgatatcctgttcaagctcatcgacaagagcctgcttaatcttagctacaaggctgttcatatcttggtcattgtgaaaatgctgatcgccattaaattgaataataacctctttacctcctgatgctgtaacagttgtttgatgactgcctgttgtggctgctgttacttgaccggaagatagttcagtttggcctttttgagatgggtctgtgacttccattccgagtgccttagctgcttgggctaataaataacgtccacggatgcctcgctcctccggaatgatccattcccgtttgtttccttcaccgacacgtgcaatctgctctttggtaataagtccgccgttagcgtagccaacatatggacctccgtgcctcatgcttctaatgcctggtacattattaattgatccatatctgcttttgatatagccaatcgcagcagcagcgttgtgaatcgggttaagaatgttattcatgcctggcaatttgtgtgcgttgaaggtacttgggattgtctgcatgagcccctgagatggatgtcctgctttcgcattactatcccataagttgattgccttcggattaccgcctgactcatgctgagcaattgtcatcagccctgggagccagctcaccggcgtctttgtagccatgatagcagccataagccattgcttcacatttccgcttactgctcccattccggaataagcagcagctagtgagcctgcttgtttttcagcaaactttttcacatcgacagaatccagaccttttacaatacctatagaggcaaagcgaccgagactcatcatgacacgggaaggtgagtgaatatcaagctcttcacgaaatgccttctcaacttttttcgccagttccttggcagcctcatggacttcacttgccttagaagtcatgcctgaaacaaaattactgatcatactgcttccccatccgtttgatgattctttagatcggataaacggcttgttaatatgagtgctgacgtattgatcagtaccagtttgtgaactattttgtccagaagcaaaacctttgaccgttccgcttccccatgatgaagatttattaacagtgttctgaaatggcgttttaaccttcgtctgcaagaagccatctgtaccggtcgaagtgctgttctgacctttagcatatccattgaccacttgctttccgtaattcggagaataagagattaaattgttcattggctgtccaacgtttttctgtttccaagattccatagaaacaacattatctccaattccttgatcaaagcctttagtgaactgttgaccaaatgaagtcgcttgttcatcaagactggatgtgtcaattataggagatacagaagcagtcaccgccgctctacggattagcggggaagttgctggttcacctcctgcagatgaagcagacgctatatcatcaactacactcatccctaatttcgaagcagcttgagaaaggagcattttgccgcgacctttattattctcaacgggaataacaaactctttacctgcttcaccaatccaagatattgttggcttcgtaatgtaaccaccagtagcatgtttctttggcttttcttttcccgtaccaaataaataatttacgccactcttcacatatccccacgctttaccagcagtttttttcgcacttgaagctactttcccaccgacttcttttactccgcccaaaatactgcttcccaattcctttacactttgccacttttcagaccaccacttcttactaaaaagggtttctgagatggaactcttaacacttttccatattgatttagcattgtcccatttatttttggaccagctttttacactttcccattttcctgaccaccacttctcgctaaataaagtggatttcagttttcctttaacagattgccaaacagaagacgcgctgtcccatttactttgagcccaaccttttacgccttcccactttcctgaccaccacttctcactaaataaagtggattttatttttcgctttacggactcccaaacagatgatgcactattccatttgtcttgtgcccagcttttaacaccagaccacttctcagaccaccattcactattaaataaagtagacttcaccttttcttttacatgagaccatgtatcacttaacccattgagagaagtcttcgcattactcttaatgccggaccatttttcagaccaccatttttgatcaaataatgtactgtttagtttcttctttacttctgaaccatcaaacgctttacctaaacttgaaccacccatggtgcctgctataccaccaactattccaccaatggctgttcccactcctggaataacactgccaatagctgctcctgtagccgctccagcaagaccaccgccagctgatccaatcttttcaccaacattatctttattcatcccaattaaatcggttgccgctaacgctgttcctaatagagggactccttttgcaaacttgccaacacttttcagaggacttaagactttcccgaacttcgatgtaccgcctgcagctctaccagctgagtatagctccgatctcgtagtggttattgctggtcttgatcctccggttggattagtacctacagttctaccggaacgccttctctccaaccgttcagatgacacaacaattgaactgtcagaagggttcattcggtttagattaccccgtcgtcctaaaactcttttccctcgtcttctacgaatgcgatcatttttacctccatcgctacaacagcaacatgttaagctgccgcttcgaggtaaactcgttggacttgtggcagttttggattctctgctccttgtgctggcattacgattactgtttctgttcctcctttcacttcgcgtattagcgccagcttcaggagtacgtttgggaattagctttcggattacgcctgctgcatcacttccgacagtacctatgccttttaacagcggacgtagtattttcaaataaccaatcaacccaattaaagaagggatcacaactttaatcgctgtttttaaatcttcccaatggttgacgctccactcaatggctacgtttaacttatcacctatctccttaccaagatcagcaatatcttttttgatctctttaagcttttcctgaccttctttactgttaatgaacgagctgattttatcaaaggctggccctaatccagttagcagagaagttcccatatccttagatatgctttcaaaatctctcatggcatcattaaccggtgtcatcggattattatcccgaagtttcgtaaagcttcgttctaattcaccgcttgttttggcacttgtaccaataccctcagccatatctaaaatcggttgcttgaggtcttcatattgtgttccaataagctcagtcgcaatagcagcccgctttgttttgtctttcactttagaaagtgcttttgccaccctaaataaactttcctctccgcttattgaaccatctttgaagcccttgaacattttcttagtttccttggctccgaacagcgttttaaatgcgtccacttggctatcagacatttcggttcggcggatgttaaactcacgcatactatcggctaggttatcgaagtttctggcgccaccctttgttccttttatcatggcgtttgcaatctggccgcctgtgagcttcaagtctttaaaggtggaactgtattcattcatcgtatccaataaatcgtcagcttggtcaccggcattccgatatacataagcaattaagtctccgctttgttttccagacaatttcaagttgttatacattgaactgaaagcacgatctacctcagcttgatcagcattcataagctgggcaatcttacttgacgactcagtcaattcagcaagagcttttttagacgcccctgtctgttgcgataagtttcttagagataaactgacttcttcccgagaactgcccgctttattgttgaaatagatctgatccgtcattcttgcaacatctttcttattaacgtttgaagttgctgacacgtaagcatcctgagacattgtactcttaccagaacccataattgaacctgcagaaaaaccgcctgcaactgccagagtaatggtagcatccttcaagctgtctattttcgcttcaattgcatccagagccgctgaagctctatccttaatagaaacagttggctcagcatgttcgccgtctacatcggacacatgacgacggatctcatctaattggtttgaagcatgatcacgaactgaaacagttggctcagcgtgcgagcgattcaaatcagagagacctccacggatcaaacgaaaacgtggtgtagcttgatcatttacggaaactgtcacctcatggctgccctcggtaagatcctcagcttgctgacgtatagaatgtaagccattcgaagctcgatcatctaaatccacttcaagcgatcgagcccgaccggtcaaacggttggctgatcggtcaattctccgcataactttctcagtccgatcttcagcatcaaaaataagagggccattagcggccctcttaagtctttcagcattgccttgtatcattcgaagcttgcgggaaatcttatcatgtaattcaaacgtggctgttagtttagccatagttaattacctcccttcttcgcttctttttctaacagctcaagcttataaccgattaacccatataagagcgccttgaattctttcggagcctcatatagttctcttaattctgacggggcgtatttgagttcatgcatcgcgtaataaagatatacagcctctttgtccccgtcctttactagttttttgccgcttcttcaaggtcttcgagatcatcatcaaatccattgatttcaattgctttgtttagccagttcgcatactcaccgccgactgaaagaacacgtttggcgacttccactggatcttctgttttgtaagcctcacgtagttccttagctttaaagttcggataaacggttgattcaactgcgattcgggcataaaagcgttggctgtctaaatcttttacacggccgcggccttttacattcttgtaagtcgtattctctttctcaagttcgtcaattcgttcagtcgtgatcgctttgaaaatgaatggaacaacattgccctctttgtctacaaatcgtttagaaatcggtacttttacttcttccgcttcaattgtttgtcctggcataaagaatgaaagatcgtaaactttttcattttgtttttcactcatgtttattagctccttttactttttagttttggacaagaaaaaaagcacattcatactttttgaatgtgctttccatataattcatgtataatagattcttgaagctaccttagcttatcctccgaatatgaaaggaggtgaaattatgtcgacctatgaatctctaatggtcatgatcggctttgccaatttaataggcgggattatgacatgggtaatatctcttttaacattattattcatgcttagaaaaaaagacactcatcctatttacattactgtaaaggaaaagtgtctacacgaggaccctcctattaaagggtagtttcttttttaaaagctagagtgctgccacactctggcttttatattttagcatttctcatgaaagtaacacacattaacaagtggtaatgtggtaatgtggtaccaactataagcttacgccagtagttgcaatacttttgcttggcaccattataacatgaatatatattgattatataattatttgtatcttttatttgttactttttttatctatgagttcaaaatgacctgatcatagaagccttaaccctttttcttttattaaaaaccctcggattatgaaagtgttatggtacaatatggtttagtataaatgaatattggctttcaacatctcaagggcggtctggctcactccctcatgaaagggggtgatgcacgtgtcaacatttcaagcattaatgcttatgcttgctttcgggtcatttataattgccctgttgacttatataaagaagaaatagacccaccccttgagctcggcaaagtaaaagggtaaagtctatcctaaatactttcatgaagttgttaagccagccctcttgatgggccaacatttatactgacccggcggcaaccgggtctcttttattttatgcatttcttttgaaagaaatacatgtttccatttggtacggttgaattacttctaaagtaatcttaccacattttttcgtaaatatcttcgttaaagtcggcgatttttcgtgaaagtgattagaatgtggattttaactgttcaggcacatcaaaatcctcaaaggtaaacggcacttcttcttccaatgcttcagaatcaacatcaagcccagcgattttcgcagaatcaaagttcacatcgtacaaggtgactcgttcagtcccacgacctgaagaggcgtcatctagaacagcttgtaaggtgaaataaggatcacttccctttttcacatagtccatcataataagaacaaattgagaagtcactttataaaaagtggctgttcccgttccatttgctccggtcgttttgtgccccgtcatccgacgacccatgatattgacctcggatttgtttttctctacattggcttcaaacgttttgatatgggccatttcttctccatcaagaaacaacctgccctctttacctgaaatggtgttttgcgcttttaatgccattcctatttcacctcaacattaaagtagaatttttcagctgcatccaccggttgaactgcaagatcaatcaggaagccgtcacgatcattattcagagcaattgtaatgtcattctctgaatcaaaatcagtaatgccctcgttatcttgaagaacactcaagtattgagtaattagcgtttttacaaactgcagtccgtcatttgtagcgggaacatcactgccgctcgcttttcgagacttgatcaatgctttcaattgtgatgtcaggtcattattgattgcatcaagtacacggacaattttgtttttctggaacatcttatttttctctgctgttaggcttgtgagtgaattaatgtccttttcaaccgatactgatttatcacgagaatcataagtaaacaagaattccccatttgacaatcgttcaacgatttcgtcgttgtcaattcggttaaggacatctacagctccctcgtattctacaaatgtaagtgattgattaaatgtagcccccgcacttgcaccggcaacccaagctgtagctttttcaggagtgatctccgttccatcctcaagtaggacaccacctgttacattgataataccctcatggtctcccttgtaatttgaaagaacaccttgaaccttttgcccttggttgtctctcagccgtttgataaacgcaacaaacgttgcttttaattgctcgttatcctctacaggtaaagcgattgtgtcaaagtattccgtttcagccgcttccaagaaagctgtataatcggcatttgtcggtgttttgtctgttccgcctgacaagcggattccggaagttgcagggagagcaccgctaacatcttcaggggccgtaccggttaacggaatagtaactgttaaatctcctttccccgtaaacgtgacatatttattcggtttaagttcttcagctttagacactgtttgtttatccacttcagattgatcaaggtaggtagtgacatcaactttcgaagagtcaataacgttctccgtaatactaataatgatgtcattacctttagtgccgccataaagagcagtagcctttacaccttcgctaatgtctgctgaagcacgaagaccttccgttaggcgataaagcaagactgtattcgccttcttcatcgcctcacgtaaaagcaacagcgaaggatcatcaatgttcaaccccacttttttattcaagtcctcgattgaagagatagaaatgaatttcttaacctcaccccagctggacgctatcggcagcgccactgttccacgttctccggcagaaacacggttctccgcggtcgttttgaagttaaagtaaataccggcacgctctttttccttgccaggtgtgaaagttccgccgttcatctatttgacctccttttgaagaaactgagaaatcaacttcttcgcttccgattttgtaatactcattttatgaacatgaaaaagagcaccgtcaaacacctcgggttttaccccaaagagctctcgactgtgctctcgcaaatccttaatataaaaagcattttctgctttctcttttttagtggccatcatttcaccccacttttaaatttaaaaccatctattgaacgctgatcttcccgctcataccaatagcggctcgtccagtttaagacaatggtggcgtaatcatctgatacccgcgtttctattcgagataggcgaataaaatcccccgtatcctcgccagattcttgtataagcggaattatgccccttctgcttctaagtgtatccgcaatcctttctgcttcattatgagccttctgtgcgttttcgtgaaagagttttacgtttaaaacataggctttctgaaacgtggatactgtgtccgccccatcgaccgttgaagccggtggaaagtaaagagacggaacagcaaagtcctgcggtattccttcttcatacacttgaacaggatacagtttgtatagatagcccataattgaacctacttcttgattcatggcagcaccgccttaaaattcttcatcgatccattgttgcagcttccgctcaaggcttctctcaaacatcaactgaaaaatagccatggcgttatcccaaaaaccagaaccgtcgatccactggaaccttagcatcattccggaatttctttcagcagggtcatactcaaaacggtcgcctttccaccgccctggaacccaccgtctatcctgatttttagacggatcgatagtaaagtgcccgtcattgacgtatgaggcgtattccagatttgttccaacatccaactttaagctgccttttgtcattgaaaagatattaccctggtcacctttctgaaaggaattaagcaagcggcgtgtgtctaccgtcttcgtcctgataatttcatcttgaataatgtctaggaactcaaaacccatagcttcaagccactcctcgtatttccctttcaattctccacgagaagcacggtttaatgactgaatgaactgatcaagacctttgatcttcacaaatattcaacctcccgtactgccgtaacttcccaatgatgattcctgactttgcggggcttctgtaatttataagcagtaccatcccaaaccgccctgtcatttactcgaatatcagcagtagcagggaaatgcacaaggaatgattgataaatagctacattcggttcttgttggataatggactgactcttttctgtaaaataacacggctgattttctatgtccggctcatcagggtacgaaaaagccggttgaacatcttcaaccggcaccccgaatttttgctgtctattttcttttttctcctgtagatggtaaatgtcacatctgtgagtcaataaggattgataactcatattgatctcatccgcactttcgcttcaatcccttctaaatcagggtcagccggtttcacataatcttttattaatgcatacacatcaggtttttgaagagaactgccatcccccagagtatatgaatagtcaccaattttttcagttgtatatcctttaataattgactcgtcgccatttataagagcataaaactgagacaactttaatagggccagtcgaaccgtttcaggcaaaggaatatactctgcatctgtaaaatcatgtccaactttaagaatgatatcggcagttgcctcaagtatatcctgttttaacaactcgtcaggcctggtctttacagactcaaaaactgaataactctttaattcatcgggagtgattaacagcataaggtcactcccctttgttatctatttcgttaaggatgtaggcaattctttcatctgcgtttttgaagtcagacggattgccaccaagattagaaataatggattcatgctctgctttattcatacctttcaattccgattcagtataatttatcggatcatccttttgattcttaagatctttatctagcacaaaatatggattttcatttaaatactcatagagttttttcgatactgtttgactgacacctgatcgaaaggtaactcccatcacattgtatgttttgcctttaataagctttgcagtatacacgccagaccacctactccttcactttcacgatcttggctactgcgtcttcttcttcaaaaacactatccaatttcgctgtcaaaacaatgataaacatacggcgacggatgtccttatctacttcaatccgaatgttacgagagaatccgagaataatattcttcggatgagttaggatgatatcagaaacatcggctgcagtatctccctctccaatcgtataaggctgtaaatttgcaatacctttgattggaacaccaaaagcagatgaaaggccaccttgaacagctgcatcccctaaatttgtttgacgatcagctacacgatctttccattcgacctcaataccaggcgatgtatagaaacggaactcctgcggaattcgcaaatatttaggaggtacagctttgtatcctcgtttaaatgtttgacgtgtcagttcctcacctgcagcatcgacaatatgagatgtagcttgttttctgatgccatctaattgtgcaagatatgagtcggaggaagatgtatccccatttacaagcaactcttcaatatcaaccgcagcacgctcagctatcatttgcatgattgtattctgaaggccatctttttcgatgttgttttcaagtgtgtcataggtaatgttaacttcagcaattacttcttttgtgcttaagttaactgtgctagttgatggaactgacttttgatctttagttagcgcaactccctcttgggctgcccttaaaatacgctgaccaaaaccgatcttctcgattttctgtgtgtcatggtccatttgaataactcgcgcatctcttaaaatggttggcgtatcttgtaccattcgaataaaagttgaagcctgagtaggattcataatcccgccgctctctaaagtagaaagcgtcatttctgctttattaataacctcttgatttctcattcgtatcctccttatccattaaaacaaccctgaccagattgatttttgaacttgttcggaacccgattcttcagtttgcttagatgttccgcgacttttttcgattgcttcaatacgatcagcgagcggttgaacagcttctgaaattgcctttttcaacttctcgccctctttttcagtctcttcttctttttctttatctttcttattaagctcttcctctttttctaatgtctcgagccgcttcttaattggctctaatgcttcttgaatggatttagttacttcctccgaagtcatttcttcttccccctcttttgtttctacctgactcagtaaattaccaagggcagcatgagcattcttaatttcttgcaggtttgaagcggaaaattttctgcccgcctttgcaactggctcttcatatgattgctgttgttttccaacaaaaaagtttttgagcaaattaaatagccctttctcatctgttttctcttgagaaacgggcttttcttgtttttcaatcgtctcagcagttcctgccattgaataaccggtaatttcgccttttttgatttgctcccatacttcctcagaagcctttgtgacaaggacccatgatccctttttaatggtttccccattcatttcaaagtctgccggtgcgacataggactcaaccacctcaccaacaccaccctgaaagtcatgttgcttgtcgatttgacgagcatctttcaggaatccatgagcggccttttcgatttctgcagctgtcatgaaatctccgtgggcgtccactgtatcaggttcatacacgataccgtaaacaagtttttgctcgtctgcctctttcgcaaggattctgacttccttttgaaaatcaggttgtttttctgatttcacaataaagaactgcttttgattagcagccttatccacataagaaacatgtgtgatttttgcgttcaccaattctcttggcatgttattcacctccttaaaataagaaaagacttctaattagaagtctcaccagctgtattctcagcaacataattgcttgttatctccattaacctttttacactcttatctacattccagaaaaatttattcataatgtagctttgtgaaatatgacttttctctaagtcatgaactatattcattatatcaagtaagctttccgcaaatgaatcattaagaattttatggcgtttcaaataatcaaccatgtataacatgcctataccttgagatttatctgccgcatcatctttttctgatactttttcataaagatttttcactgctccatataaacgaatcatttccatttttagtagtaagtcattatcccctttaatgcttgtcttctcattataatgggaatgtgtttcctcagtgatttcagaattactttctaaatttaatgaatcttttagattttgatcatcagttccatattgattctctttattcaattggaaactaatcttatctaatttttggtcaatagtgaattcaaattcccaatccttatatttaattttcgccaaggtactgatcaaatttgaaaccggttgttttaatttaaaaaccaagataattattgctaccggccaaatgattgatttgactattgaagagataaactccatccaattcatattttccccacctaatatgtaatgaggacattatactattttattccatgtttgctaagacttctctttgaatctcttctttttcttcgggtgataagcctaaaatcttactatctaccacaggcgatagaacacaatggcagttaacccgctcccttgttgatagtttaggatccctcggaaacatgcaggtttcgctactgcccggtatctgaaattcttcatctactccaatgactgtaccgtcaagatcaatgtgattttcacgaggattgttcttcttccctccgctgtgccgccatttctttttctttactgccggcgattgtgcatatgattcatgctgcgcggcagaggaagcggcaagcacttctgtgatggctgtggtacgcgcccgctccctatcaaattgtggcatgtctttgagagtcaactcaatgtcctggattgatgaaccgttctcgatagcattagttagcacgtcctccaccacttcatgtgtgtttaacttcatgatctcagccagcttctttgaccaatccttaatccaattaatcgtacgattggataagactttaaaaggcacctctggatctattgaatccatgattacttcagccatttcttcaatagtctgttgcaggaatccctcagtcagttcctgaaattcttcctcgaagtcatcctccgcgaataggttctgagtaaaaaacactagaagggcttttaacgtctcttctgagtctttgcttacaaaacctttgagaccatctaaaaacttcttatgctggcgtctgagcaatctggcaatgcctttttcatattcctccacatatttggggatattagatttgccaggaaagtcaggtaccatctcccccaattgcttatactgattttcctcggctttttgaataaagacatttaaactctccaatagcttatccgttttgttcatctcttcaaatcctccagaacatcccgcatatcttttaataacccgatcatattaggagtaccgttcttagatttaaacagtgcagccaaaggatcggaaacggacgactcgttagttttaccaagcggcctgttgtattcttcttctggccattcttcaagcgtcttaccaagtacccgtccagccaaatcgcgtaaatcattcggagaaactgcacctgctgttataaacggtgttagaaccttagcaatttctaaaggatctctaaagtctggcccttttagttggagtcggactttatgaatttcaagatcatttagaaataaagcattcagtttacctgtgattaattttcgttcaggctgaaatacttgttcctcagtaatctttcttgctgtgtcagctgtcgctctgttgtaatcttgagcttcacctgtataaagtgggggcaaacgaaaagccgatctaattttatctcggttcttttggtcatattcaagaaacaaagcatcttcttgaaggatttcagcaagtgacttaatatcaactttcactggtgcaatctcttcatcaccatgaatgtttttccccttcgctatcccttctgcttcaagtaatagaaacttatgagcgttctccactccttcaagcccattcatgtaatcctgcaattgtgtgtatgagtcctcagacaacattccattttctattgtgatggcagcgggaatatgtcttccttgtttgaagtacataaagttcagctcttcagctttacgagcaccatacaaattaacaatatggccaatccatcgcggtttcccataaataccgcttcctattttgaaatggaccacttcatttgctcgtttctccaatggggtctgttcatcatattgacctgtctctaaatttaaagtgcgaggatcaccatattctttaaaataaaccatacggccgtcaatcatctgaacatactttcggaatcgtttctctcttttgattgatttcatttgtccttgttcgaagtacgtaaaatcaacttcgattggttcagacagtttgcaaactcgtacattttgaacgtccatgtattcaatgccggctggcttattttcaccgtttcgaatgacctcaataaagccattgcccgtcttttctctatcttcaataacaaatccgagtaaagtctcagctgactcatcaaagtgaagatatttaacgaactcttcaagctttgtccattcactttcagcttctgttttttcttcatttgtcacatctggcgaattcacatcaaaagaatactcgaaatcaaatccaaagcccacaatatttgtcctgtaggcatcaacacattgctgtaagattgttgaatactcagcaatcatttttaattcctttaggttatacggaggaggcaaaatattgctgtcatagctgtcagcaaattcatcttcataaatttgtttcgttgattcagtaggtggagaggctttgatcactcgtgctttaacagatttttttgacatgctttacctccttcctggtcttgatctttgcggtcttccttttgattcttctttcaaatcggttacctcataatcatcgagagcgtaccagatagctgacagtgtatgcgggtctatggtgaactcgtcttctatgatgttccccagcttatcggtagcataagcaagcggcttaagctcataaatcgtgttctcgcaacgatcagagcaaatgatcttcctgaaccgcttgattttctttgtatactgaaggcgtgatccttgatatttacgggcacccaccatattgaaaccgtgttgctgaaaataacggattgtctttggctctgctgaatccgccttgattaattccttagtctctgcaaattccttaagttcttcggctgtcttatcatccgttaatccatttttgtaatactcccagtagatatagagatatttcttttcatgatccacagcaaccctaacgacggcgttatacgattccacaaaaccaaagtccatgccaacccgtttaagcgggcggttaatattagagattgcagtcataacctcttcatgcggtcgctcttcaaactgcggcagaacccgaattccattcacgccaaaatgacctttccgcgcaattcggtaaaggtctggatcgtattccttcaattcttcaagttgctggacatagctttctggcaggaaaagattatcatctgccgttgagtgatgataataggtgtcgttgctaacgattatccgcttttcataaagtttcttatcatccagtacaaagcgcttctccctatcatccttgaagaaatgcttaaaagtccaattgtcctctccaactggatttgttgaaagtatcatgtgaagcggcaatgtcgggtgacgaagacgtccaagaagctccttgaacccctcatattttacttcagagcattcctcaatccaaatgagggaaatattattgattgatttcagtttggctggcttatccatccctttaaagatgattctgctgccatttgaaaatcgaatctgcatcggagaagatacacatctaacgatatgatctaattttagatcacttacaagttcatcaaaaagtgaaaatgttgagtccctatgtgtgtcgtacacttctctgataacaagtgcagtacgcttttctctgagcaatttcagaacaatcttgagcgccacatgatagcttttggatgatccataaccacccacaagaaactgaaacttttgattccagtcaaagagaaattctttaaaatgtggatttacctgtttaatcactgtcatcacctttgtttacaatggtgatctcaaaaggtttatcttcttctgtaagttcttcgatctctatttttttcttgttgatatttaagcgcatatgctccaatttaaggcgtcgttcgtcttccgaatgggctaattcatcaaactgtttaattaaattcctgagctctgccattgcacgagattgagcgttcaagaacgttgcatgacgatcccaagaaaattgaaattcgaattcttcctcttcgacttcgtttgtctcagatagcacagactttttctttttcagttctttaatcatttcctgcttatcagaaacgaacatgatcttttgcgcccttattattgcggcatattggatctgtatctgatcccatatcatatcgacaggcgaacgttcttgaatcccttccatgatggatagcgtttcttctggcaggaacttagagaagaatccatgagtcacagcgttttgatttcccttaggtgcgccgccattattacctaacgcattcttgttaccgagtggtgcacctactttttttgtgtgcacacctttttttaagggtgcacccttttttctttgccaaccatggcgttgtttccacgatttaatggtgttcacagataccccatatttctcggcaaggtccttgtatttcatacctttggcgtaatccttatacgcctgtatgtgcttatcaaccatctacattcactgccgcctccttttagattgagttgttttgaaaataaaaaagctcctcaaaagaagcttaaatatgtttttttattaaattagttatttcatcaatcaaccgctcaatatattcttgattgaagttcacctcaattattggatcatcgttcataaaacctcttaatgccacttcaacttctcttaaataatttatatattcctgtaacttgatattcagttctttatcaaagagtattgaaaatttcttaacaatcagttcaaatgccgatagctctttaaaataatcagtatgtaatttttctaagtatccttctgggtgattatagaacggtacaaaggcagcagcggtttcaattcttttattgttaatattataaatctcatcaattagtatatagccttttgtgaaaatttcatttccttttctattcttcttttgtaaaacataattagttccacctgtaaaaaaaactgctgttatagcactagtaatgactgtaccaaaatctatttgaatcaatttcatcccctccttttactaattatcggcaaaagagagcgatacaggtactattcgcaaaatttgtcgaacgaaactgttgtataaaacctaaatttagtggtgacgcaggaataattcgccgcgccgacctgcctcccattttacactacagattttttcagattcaacaaacgctcaaagtggcaatcttggcataattggctgatgaactcatctttcattttgcgtacagtttcccttgaaatgccaaggtgaagacttattgcgcggtagctcataccctccatcatgcaatcataaatgactttatgctgctcaccatggatcttttcagcccctaattcaactgcatatactcgctcttcataatacttaagacgtttgaaaagacgttcctctctcatatccatttgccttagctcagcctgactcttcccaggacttccttttggcatagtagcttctaatccatattgagcaacaccccaattcttcatgggaattactgaaccatagagtaccctttgcaatcgacgaacctctttcaccatccagtgatagctattgattagattttcaatttcttttcgattcatgaaagtatcctccttttcaaaataaaaacggacaccaaacatacagcgtaatactgtaagttcagtgtccgcaggctttccgtcttggactaactggatattttatgctttaatgaattcacattacctaaggaaaaaaattcaactccctccttaaatatggtaaaattttattataaagtagtggaggttgttatatgagagttagagaaataaaaaatttactcgacaattataataaacaaattggagttagtgtttcgcacgtaccgcacagcaacagaaagactgttcttaatttacaaaagtctttagatgcaattaacgagttgtctaaacttggttttttagatgatgatattgagagatttaaagatctaggaagtatatattattcacgtgtacctgaagataagattgaagtggataatcacatcgctaatcaaattactaatcatataaaaattgtaaaagaaaaattacgtggttttggaattttaattgatcagtcagtttctgatcaaaatgagaacgtaattagcgtaaaactccctcaatacaactcattagaagaactagaaaaattcatcaaaaaattaaataatgcatttcagaatggtattacccttgaggaaattaatggacattataaattacagggttttgacacaggttcaatgtggattgacatcttagtaaacagttcagctgcagtaatatttgttggacaacttatagatgcagctataaacatttcaaagcgatctcaagaattactcattactaaggcaaacatcgaaaagctagctcttcaaaatgagcaattaaagctacaagtcgaaacttccaaagctttgctagatggaattgaaaagggtattgacacaataacagatgccgaaataaaaaatgttactgaaggagcaaattattcaacagaatcaataggacatataaaacaatcggttaaaatctttgcagaattactccatgaaggtacccaattccacccatctttagatgcaccttctgaaacagttgaagcctttcctgaaccccaaaagaatttagaagagcctcaacaattattagaaacattagctgacaatttacctgaacaggaataacctgcacatccaagccgaaggaggagatatcctccttcttgtttacctttttataaagtattatatcttcttctcatttcaccttaaaccctatctcatgatcaacccttgcaaagctgccctttacagtttgaataactgttttaccgtgctccggagcatctaaaacatgtgcagttccctgattcccatctaaaacaatgatctgaacttttcctgggtcaattttctgctgaatagtgaagtcttttttgatgtttatttctcttggattgtacactcaaagcgccccctatgttatgatagaagtaccagttcatatcaagaacactgaggctaagcgcttcggtgttttttatttttaggcagaaacctctcttatcatgacttccacccttggctcttcgctataaaacttactgactttcaaatccacaacctgactatcatctttgtatatcagatgattcaaagcatctttcacgccctttacataattatcaacgtcgggctttgtagtcggccgcagaaggcccttttcagctttctctttcttcttttttgagtttgaaactgacttaggcattggtctgtacactttgacatccattgagacaggaccagtaataattgtttctggtcgatgctgagacgcaaccaatgccacatactgtttgaaatactttgatttcgctggatcacgcatatgcaccttcccatttcgtattgatccacgcggccttccttgtgcgactggctcaccataaacagtgaacttaatgcaatccaactgttctttacctcccgtcaagctgttcccataacttaatttctttttctattctcggtgcagaaagtaaaattatcagcagagacacgactgctttaagcactcagcatccgctccatttgctttattttttcctcaagtaaacggattgttggtgtaagatctttaccttcatttcgatttgaagggccaaatatataaagtccaccagttgcttttatattcgttttctttttcattcccaatcacctaacctatgatttaattgcattcgatcgcctctaataatcactatgtaatcacggcacatctggtgaattcgtgaaccaagagcctcgtctatatccaaaatctcatcgattgttaactccgaagaaatcagcaaaggtttgtgatttaaataccggtagttcaagactgactggatttgttcaacctgccagtctgttgcccttggttgaccgtttattggtttaaataaatcatcaatgaatagaacttcgacctttctcatggcatcgagttttgcttctaagttatcaaagttagctttcaaatcacccatgccctctacataagggaaatacatgcagtgtactgattttttcttgatcagattattcataatcgccgtgagcaaatgagttttaccgctacctggctgtccaagtaatgcgatactgttttgcctttctcctttgatcttttgaaaatctttatagtattccactgcacactcataagcgtccttgatcatgtctggcttaccgtccgttatgaagttaccaaagagaagcttttcaaactcttctgtaatgccactagctgccatgagtctggcaattttctttcgtcttacacattcacactgttttgaataagtatctttccattcgctagctttatccggcgtacaaaccttacctaacagaaaatcatcttccgacaccatatcgtccggaaccataaggtctaactgttcatctaaatgccaagaagtgtccttatggactcgataaacgacaattccacgatccttacaataaggacaatcaaattcagccttttcttctgatacggcctgttttgttcccaaaaagcgggctgacctttcccgaagttcctgcatgatcgtttgaaatgcggtgtctatactgactgctttgtttatagccatattgtttctcctttctcttttgagtgaatggatttgataagatggcttgaacatatgacaaacttgcagctttcccctttaattgaaacgctgtcttgatagcctccatcactttttcctcaccataatcgtcgaccatgtagccgatccgctgtgcctccatcgggccgactgaccgagcaactttgttttcatatagctcaaaggcatttttcattttgtcatcgacctcctgatgttcaatctgagctggttccaaagctttgttcttcatgtaatttcctagttgtatgtagtctgcataatgaagtatggtgacgatgaaccctcttttttgtggaagacggtgcaatttgatatatccctgtttctccattcggtctagtgagtatttgatctgtgcagctgaccagttaaaatcttttgctagttccacaactttgataatggtctgcccaagttctagctcttgatttggcctgtattcagctcttttgaacaagtgatcataaattttttcatccctaaactctttgaatggtagtcggggtatgaccacataccccattgcttttatgtccaagtcaatcacctacttcctttcacagagtgcagttatgtcagagatgccggctcaatcaaacggaagttcatcgtcttttatatctacaggcttgccgtcaaaaggatcggtttcttgggcgcttggtttttccgtttcatctttgtttgaaggctcggaatcgataatttctgagctatccgcttcattggtaatgtcaatccgttctcttgttttatcttcctcaataactgctttttgcatttccacagagagaatcccccacttgctcaaaactgcttttaatacagtcttaagagccatcgcatcccaatcatttttccatccaaaatcagatttgctgaatttctttttgtgtttctctacttgtgcctttgtccagtacactgtttttcggaagccatttatcaactcaaaataagctgcataaccacttaccgcgtctgattctcgtttttcaaaatcaatctcgatctcctcagtcaatggattccacttctgcaattctccttcatgaatcggtatgcaattgatggacttatattggcctgttcgtaaggcaagctggatatatcctttgtacccaagctggaattgagccttacctccgtaaggaacaatccaggcatatcctaagtttttatctataggcagatcgagtgtagctgccaccattgctgaggatatgacgctcataggatctgttttctgtagcatctgctcgctgttataaaggcttaagatagaagcagtaaactgtgtagccctcttccctaacacttcctcaaatcgtttaataacagatggtgaggaaagtagccctttcattgttgctccttgttgttgcacaggtacgtttttttgtttcttttggatgttgtttttaattgattgattagtagccataatcagctaacctccttgattccaaaacgtctgaaatgagtttcctttttaactttctcgtatacatccggaaactggtctttgagctttttcgtgtcaattcgatttgagacaacaggcttccagcaagcttgatagttaccgataaacccatactctgcatccttcatttcatgtttgatttggttctctaattcttttgcctggctttgaagctctgagatctgttctttaataagcaagtattgttgaatacgttctcgattagccgcagttaaatcaatagctttgttattttccgtttcggcatatcgttttttgaggtattcctccgcagcacttgaaccatctaaagcaggagcttgtccacctaagaccttgtcattccagaactcaatctctgctttaaagatcatgtcaattaactcgtcgtctcgctcaatctctttccagacaaatttgttcccgccaatcagcacagcaaaataagctttccgatattcaggtccaagcacacccagataatgctggacctgaacgatatagctctcggggatttcttcgtcctcccattcttttaagttgtaggctgatgttgttttacattcaaggatcgctttttcaccaacgatcattcgatcaacattagccaaaatgaaattatattctggatgtctgagtattgcttttttacgtctaaccttcttgccactacgtatctcaaattcttttgcaacaatatcttctagcaatgatccaaagtaagcagcttcactttgcgattcactaacagggacctgtcctgttttgtctaaccataattcaaaaggtgtcttccacttgttcagccccaagataatggatgcatctgagccgccaattccttttcttctttcaataagccattcatcacggctcatttcagaattcttagcaagaacctcagcccgtttgcttgtcattccacctaacccccattgtttttattgaggctatctgataaaatatttgcacatgagtttttttagatagcctttaaagaagtccactttgccgagtgggcttttttattgcgcgtttttaaattcaaaaccaagttgctcccttagatacctttccaagttctctctgagaatgatttcgccgccatcaattacataatcatcaactggtgttacttcatcaccgtaaaaatctatttgtacatccgtttcagtcagcttatcgtgccagttgtttatgaccattggattttcgaccattcttattctcctctctgaatttgtctgcacgtctatcccataacagatggaattcactattgttacgaatcatcacacaccatttacgaacttccagagcagttgccggtttatgaacaaaatgaaccatcatcctatacacctgctcactacagttaagttgataccttgctgttgcattttcaatgccgtttcataaaggcgtcctttgtttgcaagccggctaatatcctcagtaagaaccttgatgcttccagcaagactaatcgcttcttcataatcaccatcacgtaatgcctctgacagcatgattgatagctcttctgctgattcgatttttctttttgcgataggaacatctgccttcaagaaatgattagtattcatactgaaaccgcctgccttccttcttgttttgccatagcaacttgatcaactagagctttccgcgtccatctatctgcaagttcctgcattttcaacccgtgagtacgaacaagtgaataaatcaatgttttgttagccgcaatcaaatcaaaaatctgcttaatatcggccatcggcagctcctctgttttacctggtcggttatccgtgagccaacgggctaaatgtttggttgcttgcagtgcttcctccaattggtgaaccatattaatcaccgcattacttgcacattcattgagtgccggatcaataggagcagcggctgtaggatgaagtttgaataagtaatgtacaagatcaatatgttcataggcagcgcacttctcaaaccatttaatacataactctggagtaagcttggcaagtccattttcaacatctgaaacatacctttgatccttacctccgattaacttgccgatttggtattgtgaaagacctgcagccttacgggcactacgcataatctgcggtaaattacgcatattgtatgggttgttctccatatgtttgcctcctgttatattaggtttttagttttaaaattgaagttgaaagaccatgctgtttataaatgacttaggctgattcctttttatttttttgcgcaagcttctcttggtgttcattcatacgctgaacaagtatgccactgaggtatttgtaggctttggcctctgcctgttcaaacagtggtccttttttcaagatgactttcataattaaaaggcctcctttgtgaattctaatcatgctgaatccttagaattatgtttcgtttcgttacatacatcctcaaaaaaaatagtccagtcaaagcctaatttctctcctattttttttgagacaataacactaggcttcctagtaccattttctatcatggtgtagtatgctctaccaatctgtgcagctttggcaacttcttcttgagtaaaccctttttctaagcggtttttcttaagccattttctcatcatttttcacccccttaatcagaaaatgtaacgtttcgttacttagataatagtatcgattcgttacattgtcaacacattttcataaaaaaagtatcgttttgttaccaaaacttatatgtaaccctttgttacgttacaatgagatatagaataaaaacaaaagtcaggtgattaatatgttctccgagaacttgaaaaagtgcagaaaacaaaagaaactaacccaacaaaatatggctgataaacttggaattactcggcctgcctacaccgcctatgaactaggtagtcgtgagcctgactataaaaccttaattaatatttcaaacatacttgatgtttctttggattatcttcttaaaggagaaagcaatgaaaaagtatttcaggatgaagcaaaaaaagtgttaaacgatcctgaaacattccttgcagcaaaagacggtgaggtaacagatgagatcttacaggctgctttggagattataacggagcaattaaaagaaagacggaaatcagataaataaacgcagttagtttattattatttatttctgtttattatgtttaattctgtttactaataagatttagattctcatttatatttcattcataccctcatttaaaaagtgattttgaatcctttacaaacccttacgtgacaagggtttttgttgtttttctcatttatattttcatttatgtttcttttatattctcatgtaaaaaaattgagcgtttattgtgagggaaattgcaaagtatcgaaatgggaaaaagggatctttttgttaaaaaccttgcaaggggtaagtgaaaaaaataaacaatacaattatcgtaacaacaataattgtttctttaataaaatttttattatcttcattcttttgtttcttttttttaagctcttcactatattttctttgaacctctttcatcttttcattcattttcatgattaaactcctttgaagtccatttattcccttgcccctatcatttgcaattgtaataattcactaatgattacaccaacaaaaaaggatcggcaagtgcttttcactcaatggtaaccaacataagcactagctggacaggttttaggatgtatctaatcgttgaggttccatttcctgcaactgatccaaaaacttccttatgaagaacaatctcttctctgttgtggggatgctaccaaaaatagtaggcaaattgatagcggtattaaaaaaacagctcattaaatgccatactggaactgtctttgatttttggatttattttctgatgcagctattgctatccgttagtttaattagaactcagataatccaagacacggtcaactctttcattgactgagcagtcgtcttcaatctttaacactggacaagataaatctgccatccaatgttcatgcaaagctctacttctaacttccattccagcattatcatataaagaagcccactctaaaaatgtttttgattgttcatatttactgccaccggctaacacttcgtttccataacgctgaaattccctgtgccttagtctctcaagccgtatatcttgtggaatccataagaagacgacaaggtcaaaataactttttagattatcgccccagccacacactgcaccagaaagaatccatttttcattgattgttaagtctttttcaagcaactttcttctttcaggaatttctctttttttagtgaatttgtctaaccaatagtaattatcagtatcaagatgcgtatgaggcaaacgctttgataatgcagcacccaatgttgaagttccgacaccagaggctcccaatatgtgaatattttttttcatacttcccctccttattaagcaaccaaactccctgtttgttgcataacgtacttactattattttgacataaatccccaaaagacctttacttttcgagggaaatccagatgcgtgttaaaatcataatacttacgaaaacagtcattattaaacggattcatattccatctccttagacgcattttcctatgaaaaaagtcttgatttccatataatatttaaacgaatccaatttttagattgtcgtctttaaggaggtttttcatcttgaggtatacaaacagtcatttagaggattggattgaaaacttatacaagaagattgatattacagaaccagaacaaattaattttgaacggattgccgaggctttagatatcaggctttcgtttaaacctgttacaagcttcgcacttaaacacagcgggatttataatatatgcttggacagccgaaaaagccgaactgaacaatggtatgatttcgctcatgaattttgccatatatatagacatgaaggcgataaaaaaacaatgcctgcaacttggacagattatttagagtggcagtccaattattttacatatcacttttgcattccaactttcatgttgcgtaatattaatctttcgtacatacaatcacatgcaattgaaaatatagcttggttatttaaggtatccccttcgtttgcgaagaaacgtttgagcatttattacaggaagctgactcaacctttatttaatcaaacagttacgggaaatctgtgcaccccccttttgtaattaataatgaaatcctcatgcatttgcgcgcattgaaaaaaacaaaaaaagacgtctcccttcacgatccgatcgggcaggataaggaagggaatgaaataagcctgattgacgttttgaaatcagaaaacgaagacgtgatagatacgatccagctcaatatggagcttgaaaaagtgaaacaatacattgacattttagatgaccgtgagaaggaagtgattgtcggtcggtttggacttgatttgaagaaggaaaaaacgcagcgagagattgccaaagaactcggtatctcgcgcagctatgtatcgcggattgaaaagcgggcgttgatgaagatgtttcatgagttttatcgggcagagaaggaaaagcggaagaaggcgaaggggaaataatgcagaagaggccggatctcatattccggctttctctatttgaaagagttatgaaaatcatttttttcatagctgataagctctccgagaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatgatagcaatcgttaatgcatttgtcagcttgcgatccctcgatgattatcaccttcattaaatgcatcaccccttgggtaatgctatgtaataactgtttgtcctaatgaggtgattttcaatgagtgtaaaaaaagaaaaaaaccgatagtttaaaaaccatgaattttatataaccaggaggccctcaacatagtaaatccatatcattggttatggaagcttattttcattacattccttatattcatttgccctcatttccttacatttatatgaattatggttaaaaaatggtgagcacaaacaataaacgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaattgccagtttttctgcggccttatatttagcgcctcctgacttgctgtagcatatttcaacgccgatagacttacggttcccggttccgtatttgccgtctcctgtgtgtgggctcgcttttagtaaaccagtttatattctttttgggcacacaacagaagcaatttttctatatgaaaatctcgtaatcttacacctctttaacttgaaggaggatttttgcatatgtattttcatacccgtcaactaccatctcatccagcatatattcctcatatgcattttcccctatttgcattccatttctttcaatgaactcaatgattctccggtatgcctcttcagtatttccgcctatttcatatccaactgcatacaggccttttggtcgtacatgataatttatgttctctgccccatcttttacttttatataaaagtaactgtaattgtagaagtctttttctaagatttgttcccgtgcaaagattccgcctatcggatatccttcatctaattcatattgctgaacttcatgaatgagttctgaaatggctgccacatattttcgttccggtaagtttaatgtttttcggcttaacatgaatgtttcttcatttaaatattcaaaagaaattgaggaaaaatcagtctcaagtgcttgttctgtaagcgtcacttttgtttgtaagatcgtttgcaactgcttaagctcatttatttttttatcaatctcaatagacttttcttttagaacatgcaggatcttgtctggtgtttttccttttattagacactttatttcttttaatggaaccccaagctctttaaatagactgatgacttgaaaaatctcaaattgatgataggaataatatctatacccattttctttttttatttccggcgagaaaagaccaatctcatcataatgaaataaggtttgtttttttacacggcagagcttcgaaaactcccctgttgtgaaatacttcttaacatcttcgctcataaaaacctccttgactatacggtaaccatataccttatgatttgattgtacttgaaaaaagcttcaagcgaaaaggataggtaaaaagggttcaattgagtaaaaggggaattcagatgaaaaaatcaataaatgagcaaaaaacgatattcattatactattaagcaacatcttcgtagcatttcttggtatcggtttaatcattccagttatgccttcttttatgaaaatcatgcatttatccggcagcacaatgggttatcttgttgcggcttttgccatttctcagttaattacttcaccttttgcaggtaggtgggttgaccgtttcgggagaaaaaaaataattattctcgggctgcttatattcagtttatctgagttgattttcggattagggacccatgtttcaatattttatttctcgaggatattgggtggtataagtgcggcttttatcatgcccgcggtaacagcatatgtagctgatattacaaccctaaaggaaaggtcaaaggctatggggtatgtttctgctgcaattagcaccggctttattattggacctggtgcgggaggatttattgccggctttggtatccgcatgccgtttttcttcgcctccgccatcgcattaatagcagctgtcacttccgtttttatactaaaagagtcattgtcaatagaagaacgccatcaactctcatctcatacaaaggaatcaaatttcattaaagacttgaagagatccattcatcctgtttatttcattgcatttattatcgtctttgtaatggcttttggtttatcagcttatgaaacggtattcagcttgttttctgatcataaatttggctttacaccaaaagatatcgcaaccattattacgattagttccattgttgcggtagttattcaagttttactattcgggaaattggtcaacaaacttggagagaaaagaatgattcagctgtgcttaataaccggagcgatcttggctttcgtgtctactgttatgtcaggatttttaactgttttgcttgtaacttgttttatttttctggcgttcgatttgctacgtccggccttaaccgctcatttatccaatatggccggtaaccagcagggtttcgtagcaggcatgaactccacatacaccagcctgggaaatatatttggacctgctttaggcggtatactatttgatcttaacattcattatcctttcctttttgcaggtttcgttatgattgtcggccttggtcttacaatggtttggaaagaaaaaaagaatgatgctgcagctttgaattaattcattttctataaagtcaagtcatttggatgcagggaatgcccctggttaggcacaataagaaaaggtacttaatttgataggctacatgttgcttgacgtgaatatagtttaagctgagttttagcaatatcaggataccgggataagaaaaaaggagaatgtagtatgagtataaaaataaaaggagtaactgatgataatcgtgctgcaattcttgatctacatgtcagccagaatcaattatcatatattgaatctacaaaaatatgtttagaggatgcaaacgaatgtcactattataaacctgtcgggctttactatgaaggagatctagtcggttttgcaatgtatggattgtttcccgagtatgatgaagataataaaaacggacgagtctggcttgaccgattttttattgacgaacgctatcagggaaaaggattagggaagaaaatgcttaaagccctcattcagcaccttgctgagctatataaatgcaaaagaatttatttaagtatatttgaaaataatattcatgctatacgcctttatcaaaggtttggttttcaatttaatggtgaactcgactttaatggtgagaaggtaatggtaaaagagctatagatatccaagcctccttgtttgctgagaaacgtttgaacttcgatcatgattacctacttaaactgcaagatcattgtttaaaaaagcctggatgaaaatttcatctcaggctttaagcatcttattagtcaaaatctcatgtgctttatccagatgttattcttttttccggacaatttctaaataattaatatgccggccaactgttttgtgcactttaaaaatatacccatcggcttctataacggatccaactgcagcgtctatttgttgagtcataaaccagccgcctatcgtatccacttcgtcacttgctaacgtcgttcccaataaatcatttacatcctcaatgagcactttcgaatctatgatatagtgattatcgtttacttttctaatatcaggcacttcatctttatcaaattcatctctgatatccccgacaatttcttcaagaatatcttcaacagtgactaaacctgaagtgccgccatattcatccacaagaatagcgatatgtgttcgctctttttgcatttttaccaataaatcatgaattggaacggattcaataacatggataacagggttgatatgattttctaacttgaaatcctcttttatcttctggtctgtgtcaatataagctgacaagaattctttagcattgataaaaccaatgattgaatctttatctccatttaggactgggtaccttgtatagctctctgtcttaatggtcttaacaatagtttcataagaatcctcactagaaatcgctacgatctctcttctcggaatcataatttctttggcgattctttcatcaaattcaaaaatattatttacatatttcaactcatttttattgatttcaccgctcttatagctttcagacagtaagatgcgcagttcttcttcagaatgagcaagttcatgttctgatgcaggtttcaaaccgaagagtcctactataaaccgggctgaaccatttaaaaaccatataaaagggaacaggatgcggtaaaaccaaataattggctttgcagtcaaaagagtgatggtttccgctttttggatagcgagtgttttaggagcaagttctccaactacaacgtgcaaaaaagtcgccatcacaaaagcaatcactaagatcaatacatgtgagactgtttcacttacatgaaaatgagcaaataaggggtgcaaaatcacttcaaaagtcgattctccaacccagccaattcccaacgctgtaaccgtgatccctaattgacaagctgacaaatattcgtccaaatgagtaatgacctttttggctgatacggcacctttttttccctctaatatgagttggtcaatttttgatgacctgatctttactatcgcaaattcagtcgcaacaaaaaatgctgttaagacaattaaaatagtaaagattataaggttaatggttgtcaatgatttgccttacctagtaaggcgtacacctccgatataaatatttattgaataaacaaaaaacagtatatataacattataagttcaaaagaacctaaaatcaactctgaatgatgtaaataatcatctttttccgtatggagagtggttcccgtagtattcaactagcgattggtgacgttttaagacttaaaatagaaagcaaaataaaaacacacctgaattttctggtgtgtttcaataatatccaaccgtcttgatttatttaatgtctttattaaggttttcttttaaaatttgaatcaattccgcctgttgctttatatttttgcggccatttctattaattgcagcaagttcacagacaattccagctgaaatgaaaaacaataaaccttcaaacattttaaatcccccaccgtctaagtgatagtcaaatttgttttttctttttgtaatacctgcttataatcttccttacgctgatatatgttatttaaaatgagtccaataatgacaaacagtgttcctactatatcaaatgcagttatgttatatcctttgatcaccatgattaacaatgtagtaatggggacaaagttaataaataaaatcccattaatggatgataggattttaatgccatagttccaactaaggagggctatgatacctggtaaagtaatcataaataaaaaatcatacttaattgctgcaatcactttaatactcggtaccgacacgtaaccttgcgcggtaagtatagctgtcatgattcctgttatagctgtgccgaataaacatgtcaatgttgaataacgaagtgtggaccactcttggaataactgtccccccattgtgtagacaacccatcctaaaacaccaatgaatataaagagtagcgagaatagatgatcccctaatgaaaaaaagaaacttatattacctttggttatgaccatcgaagcccccaaaaaggcaatcaatatactgatcattgtgtattttttaggtttcacatgtttatatccccatagaataacaattgaaagcattggcatgagtgcctcggcaatggatgctgtcataattccagacttccccatcaacctttgacctaaaaaaataagaacattgtatacagtaaacgccatcaccccaaataaaatgatccattttgctttaccctctaaatgaaatgatttttttccttctctcaccaataataaaatcactaacataatcgttaccacaccgtagcgaataaatgaaaaataaaacggatcaataaattctaatgcatgatctgcaactggaaacatcgcgccccaagacatacttgccactaaacatgtaagggcaccaatgaataattgactttttttcattgaattcccctccttttctttaaaattacaatgagaattataaaaagaagtaagcatcaattaaaatgaacaaaagtgatgaaaaacatcattgataatgatactttaatgaaggggggatcttcatggaactgcgagacttacaaattttcaaatgcgtagcccatcacaagagtattaccggtgctgcaaaagagttaaattatgtacaatctaatgtaactgcgcggattaagcaattagagaatgagctcaaaacacctcttttcaatcgccataaaaaaggggtttcactaagcccagagggccgaaaaatgattgaatacgttaacaaaattttgaaagatgttgaagaactggagcaggtctttctagatactgaaataccatctggaatattaaaaatcggtacagtggaaacagtgaggatactgccgaccatcatagcttcctattataaaaagtatcctaatgtggatttatcattgcaggctggtctaacagaggaacttattaaaaaggtcatcaatcacgaattagacggagcttttatttcaggccctttgaaacattctattctggaacagtatgatgtttatactgaaaaacttactctagtaaccagtaacaaaacgtttaatatagaggatgtttcaacgactccgattcttgtttttaatcaggggtgcgggtatcggtctaggcttgaacaatggctcaaagatgaaggtgtgctcccaaacagaatgatggaatttaatatcctagagacaatcttaaatagtgttgcacttggactcggtataacagtggtaccggaatctgcagttatgcatctagctgcacaaggtaaggtttattgccacccattgcctgagaaagatagctgtatctcaacaatctttatacgccataaagatgcgtacctgacaaattcaatgcgcagcctccttaagaccattgttgaacataaaaatatgagtatgtcttaaagtgctttttctctttctatgttaacttcttaaataaaagagaaggcgcatctccacttcgctacccttattcacaataaaatagagcagtaaacatgtgagttactgctctgcttcgtttatccaccgttcatttgttttacaatgtattcagcatcatttcctacgccttgaagcaacgctgaacctcgcttatgctgccaaggcaaccctataaagtacaatccttctacaggtgaaacacctctatgatgtatgattcgaccttcttgatccaaaacaccttttatatttatccaacataagggattcctgaaaccagtagcccaaataatattgtttacttctaatgtagatgaatctttaaaaatgatttcattttgctttgcggcaatgactcttttttttaagatgatctccttctgttttattgcatgttttaattcatgcccaaatactggatcacctttcttttgaatgaatttgcctactattgatgtatgacttgcatgtaaaactcctaatttatcaaaccaccaaaagatgcttctttttccgatcattaaagggaaataaactagtttattactacaggctaaatatgtaactctttctttggataattcaacagctatctgagcaccactattcccaccaccaactactagtacatttccatatgccaattgttttgaattcttatattgtgatgagtgtagttgattaatatgatcagctaaatcctttgatattgatggaatactaggggtatgaaaaggccctgtagcaatgacaagattcttcgtttgatattcttcccgatttgtttttattaagaaataattctttatttttaggacacttattacttctgtccgtaattggattggaatttcaaatttttcaacatatttctttagataagcaacaatttcattttttgtaggaaatccatgtttgtctccttcaagatgcattccaggcaaagagctatacattcgagaagtaaataaaaccaatgagtcataccgatctttccagctctcccccacctcatgacttttatccaaaatgataaacttttgatcggactgcttaaaataatatcctatcgagatccctgcttgaccagccccgattacgatagtgtcgtacacattatcaccccgccaatttcaaattgtcagtagacagaatctgcaaaatgctagttgatctcctcactataaagttagataaaaaatttaatggtgatggtggtcacgcggcttctccattttgggctgacaaaggatcgcattgtcgtgattatgcgcttcggtttccatttgaatggttacgtgcgtaatgcctttatgctcaagttcatgttcaattttgcgtaaaatattttcactttctgaaatggtcagttgatcgtccacaactgcatggcaagaaagagcattcaatccgcttgtgatagaccatatgtgtaaatcatgaatgttttgaattccctctgtcccttcaattgtacgaatgatatcagagacatcgatattttctggagttccttccattaagatgtgaatggaatctttagtcacattgtaaccgcttcttagaacaagaatagccacaatgatactagccaatggatctgcccagccccatccaaagaagatgatgaggatggcagctaaaatggcacctacagagccgagcatatcgcttattacatgtaaataagctcctcttatattcagattattctttgtatctccgccactcatcataatccaagcgaccaatagattcacaactaacccgatgatactaattgtaagcattccagttgttgctacttttggtggattagagaagcgttcgattgcttcataaatgatataaagagaaataagaattaaggcagcaccgtttatcacagctgcaagaatctcaaatcgtttatagccgaatgtcttattgtgatttgcctttttttcagctaatgtaaaagcaatcagggcaaccattaatgaaattgaatcactcagcatatggcctgcatcagataaaagcgccagactatttgttaaaaatccacctatagcttctattatcatataacctgtaatcatgataaaagagatcaataaaacctttttatttgctccttcattatgattgtgacccataaaaaactcctccttaactaaagtttttaatacatatgtatttattatttcaaatctgttatgaagcattctaacatgatgcaaataatatttatatatgagcatgtgttcatatataaatatacctgctctttactgaaatgtcaaaatatttttatagaaatccacaatacctccttaattattctcttataaacataaaaaagcggagcaaaccctagtttctctatccttttcttcaatcaagcatttgagggtagtattcaactacaatttacctgttaaaaattgggcctccccaagtccaaaactccagtcagcattatcattttcaacaatagatacaattaaatcagttgatgcgataccacactcagattccagtctttcggctaacagcctgtaaaatttttgtttcttctcttccggtcgggatttacttgtaactgaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgcagatctgagtgatattgctgttgattgatcaacttgtttttgctcggaatatactcagtatatagccgcatattccccctgtaatagctggaatgagccaccccagccctatgttatacataggaagaatctgagagaaaatatgattcacaacttcaatttttattcccgcctccttcaaaccgtcaaataagctgatgatgaatgcgaataataaactgccttgatacacttctgtcttccctttaaatacagaatgcaaaaacgttaaaaatattaaggaaatcgcgataggatacatcgtcagtaagacaggcattgacaccttaatgagctgggttaatcctatatttgcgacaagtgtactaaacactgataaaacgacagcaatttttttataagaaatgttcggaaataattcatgaaaaaatgaagaacacgctgtgatcagtccgacacttgtcgtcagacacgccactgtaatcattaagcccaataagattgaaccataagatccaaaataataggatgaaaccttagccaagacctctgctccattttctaaaatccccagttcttcaacgctggaagcccccatataggaaagggctgtatacataactgctaagagtacagctgcaatcgcggctgcttttgcacaaacacccatcagctgttttttggtaaaagctccttgttctttcaatgcattcacgatgataattccaaaaacaaatgctacaagagcatccagagtgaggtatccttcctgaaatcctttaaaaaacgcttgtgatgtgtacccttttgatggtgcttgaatggttccaattgggcgaataagagctaccactacaagcaatccgataaatgtcagcttaattggcgtcaaaaattttccaactatatcaatgatttttgaaggattaagtgataacaagcatgccaatccgaaaaataatattgtaaatatgatcaatgagacagggcctgcatcatttgataaaaaaggttttaccccaatttcaaacgatacgtttcctgatctcgggatagcgaaaaaaggcccgattgccaaatagagaatcgtcgtaaatacaatgccaaacaccgggtgaacacggctgactaacgactgtaagttttgtttacccgaaaaaacaaatgctgttatagccagtaatggcaatccaactccggtcactaagaaacctgcattagcgatccatacattttttccagccatttgaccaagcataggcggaaaaatgagatttcctgctccaaaaaacaatgcaaatagcattaatcctataatgatgatataggaagcagacactttttttgacattatatatcctccgattaaagtagacacttcttgaatagccaggaaacattacagatgctatttgcactggcgcagtgttgattccaaaataagtttgtgtcagttttatatatttttatcaagttcaataaaaacatgatcattttgatcgtttccgatatcggttaaaaaaccaattgcaccaaaaccatataaacaacggttccccccgctatggaaagaagcatatttttcttccacaagtgaagcagtacaactgcagctgccccaaccaattcaggaatgccatgacttccagaaagcagactcacatcttttaaacaataaatgaccaaaagcccgattaccgctgatggcagcactttaccaagatactgtacatatttcggtgtcggtttgccagacgggaaaatcatgaatggaaggaaccgtgtcagcattgttccaagcacgaccattgcaatggtgatcatttgctgcgtcatcgtcatcgtcatacggaaacctcagctttctccaatggttttctcagaacagtcagtacccctaaaatggcgagcatagcaggaataataaattggtttccgccaaaaaggataagacaggctactgaaagtccaagtcctgtgagagcactgtaatgctttttttctttcatccattgttctatgaatatcacaataaacagagcagtcatcacaaaatcaagcccttcggtattaaacttcacgtacgacccaaaaatacctcctatcgctgcccccgcgacccaatataaatggttaagcagtgtcacaaaaaacataaaccagcccttgtcaacattcgccggaacattagcggtgtaattaatagaaaatgattcatcgcacattccgaaaatcagataaaactttttctttccagtccctctgtacttatccaacatggaaattccataaaacaaatgccgggcattgaccattaacgtcaaaaaaagagcattcatagggttgaacgcaccaagtaaaaaattcgctgcaacaaactccattgagcccgcaaatatcataaaactcatgatgattggatagattgcgctaaatcccaaagaatgcataaagattccataagctatccccaaaaataaaaaccccgcaaaaatcggaattgtatatgggaatgcagaacgaaatgcagcccatatttgacctctcttattcatatgagtgtttatagcaggagagcttaaatgtaacgattctttatttttattcaaatcaacaacctcctacatttcatcaattggcacactgacagttcttttttctgtactcatgactatgcttgtgtcaactccactaatagcagggttctgcattaatgaatcaatgataaaattccgataactctccatgtccttcgccacaatcttaagcatatagtcatggcttcctgtaagtgtgtagcattcttgaacctgtgggaatttgtttatatcctctaaaaatgaatgaattgtctccctatttaagggtgataagttgatgagagctagtgctgtgacttcgattccaagttttttctcatcaacaatagtcgtaaactttttaattatacctgcttctactaggttctttgttcttgcaaggcaagctgatggtgaaagcccaattttcttagataaatttaaatttgatattgaagcatcttcctgcaattctcttaaaatggccttatcagtttcgtcaagcataatactcatttgataacccccaatacagcttaacagaattatatttcatccaatttaaataataacgaatttttattcgttaataaaatattatttaaatttaaatccttttaaaatattattaacagaataaaattatcctcatgattaactcataatgaaattaacttacatcagaaagtagtcatgggacttgtgtgacttgataccaacatcataagaaacttatcagaagccaaaaagttattgcggtctcaacgaaattttaatttgtggtgccctattgcctttttctgcgaacgaaaactgttaaaattcacaaaacagaaagtctactctattattattttaaactcgtcctctaattcctcttgagcctctagtaaaacttctaatacatcatcagcgtatgaacctaaaaactttttactaaactcaaaatttatcaagactaaagtgagcggcaaatccacccaccctgtcaggcaatcccataaagcgtctaaatttctcccatagtagtttgggaagtctaatttatcttttaaaacatcatgtaaaacttctatattttcaaagtctcttccatctatcattatttttctcattagaaacaatgccctccattattttatcttaacaaacgtttactatgtaacagctgtttgtccaaatgaggctgaaaacaaataaaaaacaccgatagggggaaactattggtgtttgcaagatattttcatgcccggtaggcataaataatgctaaactttgtttttgaaaagctatcatatcaaatttttatgttacagctttactatcgtttaatctaattgaggagtaaaacgagtatgtttgaaaatcacatatccccaaaaaattaaaaactaagcggcaattcttcgagtgctctcatcagaaaattccctttccatttcatttgttccttttcgccttttaactgtatatttggacagcggcgtaataaggtggaaatcgcaatcttggcttctaagcgggctaactgtgcaccaagacaaaaatgattgccatggccaaaagcaatatggcggttgttctttctttcaatatcaaatatgtcggcatttggaaatatcttctcatcacggtttgctgatgctaaagaaatgatgatcacatctttccgtttaatctcctgtccatgcagtataaacggttcagccgtccagcgaattgtcgttagctcaacagggctgtgaaaccgcaatgcttcttctatggctgaattcatcaagtctggctgctggcggagcttttcaaattgatcaccgtgacacatcagagcatatgtcatattggtgattaagtttacggttgtttcatgacctgcaacgataagcagcataatcatcgagtacaattcttctgtacttaattgtgtgccttcactttccgcttgaattaatgcactgattaaatctcctgcaggttctctcctttttttgcgaactaaggattccagatattcaacaaactcccctaacaagtggtcattctcctgaagtctttcaggggcatctgaaaaatcaataattgcttgcgaccacactctgaatttttgacgatcttccaagggaatgccgagcatttcacttatcacgataatcggcaatggaaacgcataatcgtctactaggttcatgaatttgttgggctgcactttatccaataaagaatctgcgatatgctggattttgtcttccaactggaaaatcatccgatgcgtaaatgctttttgaacaagagttcgcaagcggttgtgatcagggggatctgaattaagcatatgctttgttaaagactcttcattcttcaatagagcaggacgtttttcttttgcggtaaatacattttcatagtttttctttaatttttcattctttaataaatgtattgcatcttcatatctcgatatgagccagcctttccccagagctcctaaagataatgggtagagaggctgtgattttcgcaattctttataaaattcatacgcttcatctttaaatgctctcgaagacaattgactttccgtcaaaatggttacactatttttttcttttgaagacattcattcgacctccatctttatgaaaggttaagataatctttaaatataaaatcaatacgatttgtaaaatgatctattgagatcagcattcgtgataagggccaagatgccgccccgcattttgaaataaaaggtatgagtcagtcattaatcattttgctgcccaaactctttccctgataaaatggcgaaactcctaatacttctaaataccatgccggctcttataaggatttggaagatttttcagccccattttgattaatgttatcccccctgctgctatataatcgatcaagttaatgtcgggtttatcacgatgttttaatagagcggcaacaaccatttcaccattctgaatgtcaacaaaaaagaaatgctttttaaaatatgctcttgtcagtactttatgcatttcaaaaataaatgaatgatcttttttttcgcgttttacgagtaaatccataaaagnnnnnnnnnnnnnnnnnnnnnnnaagagctttgccactttgcttcattcatctgcccttgcttgtcgataaagaaacattgatacatctcctctgagcagtaaagcaggaaatcgaattaaagcgcccttcctattggaaaggcgcctgccgttttactgtgccaaaatgtttttcatcagtgagtttttataaaatcatttattaattgatcagttgtcaatattgtggcaaattcatcatgcaatgtagctagagatatattatgaatagtcgccgcatcataatatgtatcattttggtctctcattccgaaggctgctgttgcatctgaaatcaggtatgtatcaaaccctaaattaccactcattcttgtggtggttgatacacagtgaggcgtggttaaaccagttatgactacagtggttatttcatttaattttaagaattcttctaaattcgtaccaataaagctgctatttactgtcttggttataatgacttcttcatccataggcttaactatttcctttatcgcaaacccttcattctttggatggaataaagaatgaggtttatcagaagtgtgttgtatgtatatgactgtccatcctttttctctccataattttagtattttactaatgttttcttccgcctttacgttattccgttccccccattttttatcatcgaaggctttttgtacatccacaatgattaaagcttttttcttttcttccacaagataccctcctatgtagaatttctatttattactacattctaaatacaaattttacttttgcacaattgtttaatgatgaatttcaaatgagcgccttctttattggaaaatgcgttctatactgcaactgtgcccaagccgttaaccttcaaatctaatctcagaatcactggctctacagagaataataaaaaacactctaataacgagtgctgaaattaaaaactattgatttagaagccatttgatacgctcagctgaaaagatgtagtggagtattattagacataaaaagacaataccaactggttttaaatgactaaaataaagcgctgcaacagccattgcaaagatcaataattcaataactaaccttgttaccccgtttacagctattacagtttgtccgcttcgactaggatcatgaggtactgcaaatacagaccagacaatcataactgcaataggtaaaaccaaagttaaaacatatttaaaataaccattaaagcttatccaagcaaacacgcctaaggagattagtgcagcaatttcaagggtgaatcttaaaagtaaattagtctgattcagtttttccaactcctctataaaaaacacccccgcaggagatgctctttctctgctttatttcaacgtataaaaacttttctgttcttcctctttagattctattgtagttttcggcgagattacctctacttttgaagaggcgataccgactgctgctattaccaatgctccgattaatagaacgatgataagtataatgaaatatgacaacttttcccctcctatccagttaattatccaaataatcaggaagttgtctacaatttgcagaatttgtcgaacgaagtaaagattatacctgggaggctttactcattgtatgaattacagtaatacactaccttcccttttgagaaaacgttgcaacttagctagactcttccaataggcttccttttggcgcagctgcttctagtcgaaattgagcaatacctgaatgtttgattggaatttctgaaccatagatcgctgctgaatttgttgcaaatgcatacgtaggagtagtcgaatggtggttgaaaaatgaaatgccttacccacctcgagtgatggcagaaaaagcggggttttgttagagaggaatctatagatatgtgtatctagaagatttgacagcattaaaaattatacttacatcgttgggaataggccaacaataaagcggaagaacgttgtcatttgaagtggtttggaataaaaatgattcgaatatgttcttatcattggtaaacgaacaaaaaaagaacatgttttgaaaaaagattgatcaaaacatcttcttatatgttgtcatagcgtaactttttataaaaaggttgattacattttcggggcttccaaaccaaattttgcccattcttcttttgctggaccataaatacctggaacagttaaacctgcttgtctcataagaacagtcatttgtccccgatggtggttttgatgttgaattaaaaacatcaaaagtgaaccgttaggcaattgttgtccgataaagttgatacgttcttgaagtgtatggtcagtccattgggtttttaatgcctgtacaaatgcattactggcttgatgatagctgtcagctataaactgagccgaagttggaacaggataatcttcagctggggcatggaacgttaagtctgtgtttgaggtaatgatgcgaatggcagcaacagtatgccaagcaatacggcctagagtccaattttgtgaagttatttcttgtttaagtgattcatcagtcagattatttaatagtttctgtgtagcatctgcttcgaactcccaagatttcaaaaaatggtctaaggtttgaaacacaaaaatcctcctttttgttttttcaatgtgcctataggttaattataatgcctcgtttcgttaaaaagaacaaaaaattttggacaagaataattatagtaaaatgcgtagacattcttaaacataacgatttacgcatctttttacaaacatggtgactccttggtctccattgtcagcgagaatcaaatatcatatgaagacaatcctatattcttatcactttactgagcaataaataccttccgtatacttagtgatgccttcatcgtaatcaggatactgatatgcaagactttctgatacagcttttgaatactttctaaataatgcatagcaagtaaataaagacttccacatttcctgatacccattcacagaatatgtagacatgagttcctcccattctttatttgaaaggtaccgcttcataaatttatagttcttccccatactaaatgaataccctttctgagatgcgatatgccaggccatcattctcaataaattaggacgtacaatttcatttaaatggtcaatggcaaaaaggatttcatttcttgctagtccttttactacgtaagtcgaaaccatccagaactcattacagcaatcatcaaattcccttgcagtcggctttttcatccagtattggcgatcatttggggtcactttatagttgatgaacgaatccttatcgagcaagaccttaaccaaaccatcgttattagcaaaataatcttctgcttcacgaattggaataagggttagatctaatttgttgccatcctcaaaaagaatgatgtatgaaaaccaattacctaattcgggaggaaaaagctccatatcttctggtttttgcatcataatgcgcttcccaaagatttcgagccactgatcattttctttaaaagattctacatcagttacaaaatacgagatgtcataatcttggaagttgtcaggagggatatttctgtttgtacgtgacccttccaaagtgaccaatcggattctctcatcgttcaaagcaaagtccaagaaaatgtccatcatttcctgctcacttcgcatcgcatgttcctccgtttcagccttaatatctaactgtaaaacgtcttatagatttttttactcttgaatgtgatgtattcttctaagctttattttacatgaagtccttctatatatcattcaaaattaagatgcaagacatctcaaaatcagatatcaactatgaaggactacatgaatattcagttttttgtagagccgccatgggacgacactatctttgacacactttaatcccccctgctttatcgacatgttaactggtatgagattgacaaaaagaaggaaaacgatatatttaagcgaatacgagtttttgagcaaattttaaaatgacacttttttcaaaaatcatgtcttaacggggggattcggtatgaatgaatttatgaagaagttttccttaacaaaaccgattattcaagctccaatggctggcggtattacaacgccccgacttgcatctgcagtttcgaatcaaggtgctcttggcagcttagcatcggggtatcttacgccagacctgctagaacaacagataaaagaaatgtttgagctgacagacgctccttttcaaattaatgtgtttgttccgctaggtctagagatgccaccagaagatcagattaaaaagtggaaagaaaacataccgttagctaatcaagtaaatcaattcacatctgtacaagaagagtgggatgacttctatcaaaaaattgatctaattttaaaatataaggttaaggcttgctcattcacttttgatctgccgcctgaagacgcagtaaaggagctaaaaaccgctggatgctgtttaataggaaccgcttcaacagtagaagaagcattgttaatggaagaacggggaatggatatagtagtccttcaaggaagtgaagccggtggacatcgcggagcattcttaccttccaaaggtgaatctgccgtaggtttaatggctctgattccacaagcagcagatgcactgagcgtacctgtcatagctgctgggggaatgatagaccatagaggagtaaaagcagctttaacccttggagcccaaggcgttcaaatcggttctgcctttttaatttgtcacgagagtaacgcacatccagtacataaacagaaaatactagaagcaaacgaagcagatacaaagcttacgacattattttcaggtaaagaggccagaggaatcgtaaataaatggatggaagaaaaagaacagtttgagacacaaacccttccgtacccttatcaaaatacactaacgaaggcaatgagacagcaggcttcacttcaaaataaccatgatcagatgtctttatgggcaggtcaagggatacggtcattgactgaggaaatttcggttaagcagcttttaaatcagctttgccaagaagatataaaaatataggcgcacctcattgatagagcaaaaagcaaacttcgacaggcagtttgcttttttttcgtaatttcatcccctgactctggaaatctaaatactcctacattttcaaagctaattgaatcgggttaccaatcatcccattgatacgatgcgatcttaatgatttcaccacaaccacaatacatcaccaacatttcgatcttatctccccttctcaaattttgctatctattcgaaaaatcgataactcccatattaaattcgaatagtaaaatggttgtttttcgtttgattcagatgatataaagtcatatgataaaaaaagaatgagacagaaagcgtgagaagtgatgaaaataggattttttgattcaggaattggtggcatgactgtattgtatgaggccataaaagttcttccttatgaagattacattttttatgcagatacgttaaacgttccatacggtgaaaaatcaaagggtagagttaaagaatatattttcaatgcagctgaatttctagccagtcaaaatatcaaagctcttgttattgcgtgtaatacagctactagcattgcgatagaagatcttcggagaaacttcgactttccgataatcggaatcgaacccgctgtaaagcctgctataaataaatgtacagaggaaagaaaaagagttctggtagttgctactaatttgacgcttaaagaagagaaatttcataatctagttaaagaaattgatcaccatgaccttgttgattgcttagctcttccaggactagttgaatttgctgagaactttgattttagtgaagacaaaatcattaaatatctaaagaacgaactatcttcttttgatctgaaacaatatggaacgattgtgttaggatgcactcattttccgtttttcaaaaacagttttgaaaaactgtttgggataaaagttgatatgatttcaggcagtgtcggtactgcaaaacagttgaaaaaagttcttgcagatcgtaatcagcttggtaaaggatcgggctcaatcacctttttcgattctggccacaaaattgtggaccaagaaatcatatcaaagtacaaaagattgtttgaaatattagatgaaactcaaaggagtcatgttagacattgaatgtaaatgaaaaagacaatctcctgaagagaaacatgaactaagaagcgggcttaaaaagcccactttttttctaacaaacaattgagttatacacacatatctgattacagtgttttcgctctttcccctcttatttctaccccatctctatagcttttctatttcaataaaacacaagtctcgattgaaaagttatcgtaacatttacacttcacaggacatttttcgagattagaaatcgaccgtttgccagatacacaaagtcataatgtgtaaattctgtgtctattcgcatgtttattatggaattattttcataatgttttataatacaagatgatagcgttttctaattataatgataggggggaaataatgatgatgaaaaaaggactgctcgcgggtgcgcttacggcaactgtgctttttggcacatgtgcagtagatgtgccgggtattattagtccaaaaaccgcagaagctgcatcacagctaactgatggaatcggcggaagggcttacttgaacagcactggtgccatttttgttacgaaaatccagcttcctagctccattcaggtttcaaatgggacagcctacatctactctggctttagcgggggcacagaatccgatatcgggcttcagtacagtgataaatataatgtatggaaaccatatatgaaagtcggttcaaaaggacaggatcaggttcagtacctcgaaggaggaagccaattcacgaatacgaaaggcttccgtcccggcagcaccgtacaacttacaatctacaaaaaccttaacggcaatacccgcgctacatactggggcacgaacaatgcgggatacaacggccgtctcatttcagaaatcagcaaaacaaatgtcggctccatctccaaatggaaagcgcttgctacagttgctacaacaggttcacgccaatctatcaaatcaaatttttcaacatcttttacaaacatcaccatcgacaacaaagcaataacacctgtaattgatacacaagacttcgctaaagtaacagtctcaggcaacagtgtcagtttatccgttgtgaaaaattaaaacatgttaaacatacaatgcgttaggctattgagaagctctcgatagtcttaaagggggcttaacatgccccttttttcatttcaatttaactttcagttagcttcggtgcatgccgtctatccccgtcttttatctgggtgaagtaaggagcagctcgccccttctgagcctgttccatttgctcaacgcaaaaggtgtgcatcactgtcttaaaaatgttaaaacaaatagcagatggtgcactttatttttagatgaggcatgcttacgctcgatatgcaagtcaaatgattaagggtctgcaagagagagaagttttgggtgtactttcataaaagaggggtcttcatatagcttgattgcaccaggaagattaaccagcgattggccgagaacaacacatcactttgaaacggattcattccaaaataataagtatgatccaataactaataaagatcagttagcagtccagccttaaaaatatttttacatcaattaaactagcatcactatcgaataagctcgatctgcatatcatgtactatcctcttttaaggaaggtgatgttatgaggtcatttccattaattgtagttctattcatcctattaatcatcgttgggacatctttctttggtggctattaagaacacaccttacctcatatccatcagacgccataagaaatctttatggcgtctgttttttattagatttaaacaaaaccattaaagtggggccatgcaaacacacctatggagattactgccacgacttctttgtgagggaaatattcttccctttatggactattgtcgatcaaaagagaaagttgaaatacctttttatggtgagatgaatcgaggcttagacatataaaaaaccgcaaagctttcttgaagaagctttgcggtctttgggtctcttctttgcttcatataagccaatagatttcaagcgtaatccactgccatacatccaatgattttttattttgaaataggtttcttctactcttcctgtgagatgactcaaggtatgccacgtcacaataatgtggcggatcctgagtggtctcaatcagttttttccccattctatcaattctccacagaaaaaaatggctatggcagaaaaactttcatagagtaatcatcatttaatgagccatcatctcatgggcaatatcgtgtccatccatttttgacgggtagtaggtaggccagtttttgacttcatcaagtaaagcttcacggtcgtccccccaatagagatggtaatgactagctttagtcgggtaaatactatgatcactaaactgaatatactgaggcagcccttctgcttttttagctagtttgaatatgtatcttacccctctattgcccgcatcataggttagaatttcgtatccgtcatacgtatacttaccagaatattcttgtccatttttgaagaacgttacagtatctttctggattacaatacggtcaacatctgtttgatagccctttttataatactctttatattcttcagctgtcttgccgccttcgtgttctgatttatatgaaaacacttcgtcaagagtaccatcttgcaggtatggatatacagattgccaatctccttcccaatcagaaagtaagcgatcctttacttggctgtttttaaaatagccttcatatattttttctgtttctttatcatgcgcatgactatgatcgtgagaatgttcgtgtgtatgactgtcagatgtttgctcttgcgttttggaagagtcttcttcaactgctgaggaggatgatgttgttttattagactcacctgcagaagaaccggaagtctgacatcctgccaaaactagtaatgaaccaatcgttaatatgcctagcggctttgaaaataaaatgttcattccaacactccttttttattaaatcgaaaacgttacgatttatattatacatacatctcttacaaacatcaaagggaaaatgctcttcatgcggatggcctattttaaaggaataactgactttgttcatcagttattcctttaaaatacgaaagtctacgatatttccatatcgatccgcttcaatatgacagcacccctcaagcagctgttttaattttctccgtccgcgttgtacccttgattttgctcccgagtaagaaatgccgagcttttcactcaactctttttgtgataacccctggaattcagttaactcgagagcctctcgatacttttcaggcaaccgtttgatggtcgatcgaatacacacagttgcttccttggtgaaattttcttcctctgcactgtcattaaaatgtagaacatcaggcaatatttcgcttgttttttttgtacggtaaaaatcaataatcgtatttctagtgatccgataaatccagctgtcgatcttttgttcattgatcagatttgggagatgcacttgtattttcataaatacgatttgcaagaggtcatcaacgatagattgatcgttaaccctatgtgaaatatatgtttttaacggctgatgaaattgatcccatagatcctctatattcatttgaaaaaacctcctataattttgcgtctgctttacatttgcttcgtctttttaatcgtaacaaagagcgaaacaattgttgaatcaattgtattgcagctgttgcaaaaaataatgataaaggagaggtttgttgtggagtatacctatttagggagaacaggattgcgggtgagccgtttatgtttaggcacgatgaattttggagttgatacagacgaaaagactgcgttccgtatcatggatgaagcgcttgataacggcattcaattttttgatactgccaatatttacggctggggcaaaaacgcaggattgacagagagcatcattggaaaatggtttgcacaaggaggacagcgccgcgagaaagttgttctggcgacaaaagtatatgaaccgatttctgatccgaatgacggaccaaatgatatgaggggcttgtctctatacaaaatcagacgtcatctggaaggatcactgaagcggcttcagacagatcatatcgaattgtaccaaatgcatcatatcgataggcggacaccgtgggatgagatatgggaagcttttgagactcaggttcgctccggcaaagtagactatattggatccagtaattttgcaggctggcatttagttaaagcgcaagctgaagctgaaaaacgacgattcatgggacttgtcactgaacagcataagtatagtttattagaacgaacagctgagatggaagtgctgccggctgcacgggatcttggtttaggagtagtggcgtggagtccccttgcaggagggcttcttggcgggaaggcattgaaaagcaatgccggaattcgtacagcaaaaagagcagatttaattgaaaaacatcgtttgcaactcgagaaattttcagatttatgcaaagaactaggagaaaaagaagcaaatgtggctttggcatgggtgctggcgaatccagttttaactgcgccgatcattggaccacgaacggttgagcagctgcgtgatacgataaaagccgttgaaatcagtctggataaggagattctccgcatgttaaatgatatctttcccggacctggaggagagacacctgaggcatacgcctggtgatacattcattactcaatactaacatttttcttatatatttatactgaactatcatattaggaaagacaagagcttgtttgtctcttgtcttttccacatcatgctgaaaatgctggctaaacatcgacaaaaacgctgccgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatgcttatttgattacgaaattaccgtactcgtttgaacgaacatgaatcggtccgtttaaattgtagttgttctccttggcgatagatcgaagcacgtccacacgggcaactgattctctccattcgtcacgggtgtcatgattggccggattcatcagatcgtcatagcgtacgtccaagaatttatttaaccacttcttctcgtctattccttctttaggtgatccgcctgcttttttgttcgtacgtttaatcaaggcataaaaagagtcagggtcatcaccatcgccatgttgaataaccgtatcgtacatcacagctctagccaatgctgtttttagtccggcattgtccgatcgtttcatagcaggctgataatacaaatggtcatttactttgtcttgagcggcgcgaaatttcttatcatttgcaagcgacttccaggcagaagcgaatcccttgagattgcttgtatcatcgctttcttccttggccagacggcgcaattcaggcagatactttttcagtttgttattcggaactgcctttgtgtatacttccactacttccaatgcatccccggtagccgttgtaaagcctgcccgtccgcatgtatagcctcgcccgtcatccaatcgctctacatatccatattggatctccgttgtgccgttttcaaagatacttgtcagctgttccgcccggcgcttttgatctttattcaatcccgccgcaaaaaccgtttcgctcatcatcagggtaaaaaacatggtgaaaacaagtaatgagatcgctgcctttttccaaaaatctgctttttgcatactgattttcattttacttcccctttctaaatattgtaaatacagactcagtatacatgaagaaactgccctattgttgaaaatacatcgatttgtcaatattttgaatctaaagtaatatagcttgaatcttactcttttgattgccaatcagccttagcccctctcactgggaaggtccctttcttactgccaactttaattaacaagatgccataaggccttactctattttataatggagatgatcatcgaaaatcgttagggaggtgatgtaaatggcaagcaagatgagaatgccagattccgcaacgtcccatgcaaagcctactattgggaaggcgatactttgcatggggtagactttctaaaagatcgcccaagtaagcttttctgatatagtggctttgcaccttatttgacataaaaaaataaggagctggcagaaatggcatatgtaaaagcaaccgctattttacctgaaaagctgatatcggaaattcaaaagtatgttcaaggaaaaacaatatatatccctaaacctgaatcctctcatcaaaaatggggtgcgtgttcaggaacaagaaagctgatcgatgacagaaacgcttctattaaaaaagcatttaaaaacggcaaaaccattcatcaattatctgatgaatatcacctctctattgaaacaataaaaaaaattgtctactctaaataaacaaaacggaagcactgataaaaaataatcagtgctttttatatggcgagtttgtttcttagctatttcctgcatatgaacattttggccaattgtgtaaagttaaaggagatgagaagaaaggaaggtcctacaaatgacgataaacaatggaacgttgcaagtacctggagcgaacatccactataaagtgcgtggctcaggtcccatcattcttttggtccacggcggaggcggtgatgccgacaagttccatcatattgccaatcatctggctaacaggtacacggttgttacttacgatcgccgcggccattcccgcagcaatctcaccaatcagattgaggattaccgtgtggaaacacacagtgacgatgctcaccgtcttctagccaaaatcaccaataagccggcatacgtatttggaagcagctccggggctgttatcgggcttgatctgtgcatacgccatcccgaacaagtacatgtcatgatcccacacgaaccgatcttattgcagcttctgcatggaaatgagctgaaacaagccgagcaatttatggaagaccttaagaaaaatcatcgaagtgaagtcattaagttaatgtcaagattagagacagacgaacaatcaaaggctgtgctgacaaagcggcttctcggcaattcaacgtatttcactgagtatgaaattcaaggaattctcaactatacattagatttcgaagcattaaaaactgtgtttacatcttcaccgatgaaggtactcccagctggcggaagtgcttctcgggagctttttccttatcgttgcgcgaacgccctagcggaacaattgaaaacagaattggttgaattccccggaaatcatacggggtacacaatataccataaagatttttctgagaggttacacgacatgttagaaaaagaaaagaaacatacgtgttaaggattaattaaaattttcataataggacaggtaaaactaactatggaattagagaagatttcacgaagcgtaaaaagaacttttcactaacgagaacgcaatgtgagatgtttaaccaaagtgatattaggaatttcatcgaaaaataggtttgtacattacgttctcctattgattatttcctatcttaattccgtatttataccattagattacaactctaaagcggctcgttattttgtcctcaacaacaaccagtgtctaacatcatgaatctcttttgaaaatcaccacaaatgcagatatggaagacttcatcgcaacaaaaaccataccaactattgttgttggtatggttcgtcctagataggcccttaagaagagattctattgtacggagtatttagctaattgcatttgtaaccgacagggccgtctgatcctgtgtacacatatgtgtcagacacatatccaatattcacgacaccccgggaatctttccactggatttggtcccagatattactcgttccatacttccctgtaacagtcgttccataagcgtaacaataataaggaacacgggagccgctcggaatggaaagcataataggataatttgtaccaggaccgctgcgcatattgacaggcgcaccgctgcttgttgagacagtaaagtactgaacggcaagtgcctgactggaaaaaatgaataatgatgcaatcataacggttaacatactcagcattttcagtttagtcaatgtcatccctctttcttcaattccttcattttaagaaacgatagaacatatgctaccagctgcatttaggaacaaccggaccgtctgagcctgtatacatatatgtatcagagacaaatccaggaacgatctccccgctggcaagcgtccgctctgtgtaattccaaatattgctcgttccatactttccagttacagttgtaccggttttgtagcaatagatcgggatgcgggttccgctcggaatggtcgttacaattccccaacttgtacctgggccgctgcgcatgttgacaggagcaccgctgcttgttgaaaccgtataatactgagccgcaagtgcatggctagaaaaaatgaacacagatgcaatcatcaccgttagcatacttagcctctttaacttattcaccttataccctccccttataaatgccgtacgtttgactttcttacatccagttaaggatttactttcagataccatgccccctcccctcccatatatttatcaatgtaccataaactagatctttcaaaagtggaattattcctatgttttcgacaattaaggatacaaaataaatggtagtcagacttgatattgatggtgtgttacatttggctcttaatcatttgtccagtcggtaatcacgattgacaatcaggaaaaaggacatggatcaagcggcttcgtttccaccaattaactcaatcagtgtactgcttccttgtatccacgcttcttctcgattcatagatactccacctttttcaccaatcaaaaacggacaccatacaaagcagcgtaaatgctgcaagttcagtgtccgcaacctattatgactttgctttcttttaccagggcgtataaaaatgattaggtacgttatcaaacgttattctatgattttgcgagtcgaaaaatcataacattttatatatttcaatcagattatgatctggatctctgaagtgagcaactcgggcactccattccttgcgatcatgcggtttattctcacatttaactcctttttcgtgtaaatcgtcatacgttttatcaacatcttctaccttaaactgaagcaaaaattttgattgagcttctccttccaaggactttttttcctctccaacgatttcagccatcgtttctcgagataaaagctctattttcgtttccccattatcaaagagtgcatattccatttcattctctaaccaacttattggaagtcctaatgaatctttataaaactcgacgcttttcttaaaatcattcaccaacagtctaatttgtaacagcttcatatcgagtgcctcctataaaaccatacttttactggtcatccaatttaatgataccaaagaaacctgacagccctatgtcaagtttccatacttcacccttatatctgatttaagtgcagtttagtccatgtcataagaacgagcaaaaacagcgattcttaaaacaaaaaatgataccgagtgtattttctgtatgcttcaacttcatttcgggaaatgtaacgttgataaaaggaggttacatcaatatggatcatcaaacattggcagctcatgaggctgttgacttacatgaaatcgtgaactttaaaacactttgtatagcgaaatcaaagttaatgcaagggcttgtgtttgaccaagaactgaaggacttgatggaaaaagatgtacagcaatccattcaagaccttactgaattacaagcggtttatgagcgtgcctcatttcaggcccctgtccctcaaagccgcccaacgccaatcatcaattgaaaggaaggtaagcctctttgaataatgatcatttagaccccattaattcgctgaatgtgcctgaactagcagacactacattcgcgatggattttcttatacgagctaaggaaggcgtaaggaatactgctgtagctttgacagaaaccgcttcaccagatgtaagagcactgcttcggaaacagctgatgcaaggaattgcgatgcaccaagagattacggaactgatgatcagcaaaaagtggttccatccatatgagctgagcgaacagtataagctggatcagctctctgcaaaaaacacgatcatggtcggcaatatgaacctctttcctgatgaaacaaatcgcaaagggatgtttgaccggacacctgatgaacactaacactggaggttttacagcatgaaggcagtaacgtatcaaggcattaaaaatgttgttgtcaaagatgtccccgatccaaagattgaaaaatccgatgacatgattatcaaagtcaccagtacagccatttgcggatcagatttacatttaatccatggattcattccgaatatgcaagaagactatgtcatcggccatgaaccgatgggaatcgtcgaagaagttggttctggtgtgactaaactaaaaaagggagatcgggtaattattccctttaatatagcatgcggtgaatgttttttttgtaaaaaccaactggaaagccaatgtgatcagtctaatgacaatggggaaatgggtgcttatttcggctattcagggcaaactggcggttatccaggcgggcaagctgaatatttaagagtgccgtttgcgaattttacccattttaaaatccctgaatcttgtgaggaacccgatgagaaattaagcgtgattgccgatgccatgaccaccggcttttggagtgtggataatgccggcgtaaaaaaaggcgatacagttatcgttctcggctgcggaccagtcggcctgtttgctcaaaagttttgttggctaaaaggcgcaaaacgcgtcatagcagttgactatgtaaactatcgcttacagcatgcgaaacgtacaaacaaagtagaaatcgttaattttgaagaccatgagaatacagggaattatttaaaggaaatcacgaaaggcggagcggatgtagtcattgacgctgttgggatggatggtaaaatgagcgatctcgagttccttgccagcggcttaaagcttcatggcggaacgatgagtgcattggtcattgcttcccaagctgttcgcaaaggaggaaccatacaaattacaggtgtgtatggaggcagatataacggttttccgttaggagatattatgcagcgaaacgtcaatatacgctctggacaggctccagtgatccactatatgccgtacatgtttgaactagtatcgacaggcaaaattgatccgggagatgttgtcagccatgtcctgccgcttagtgaagccaagcatggctatgacatttttgattcaaaaatggatgattgtatcaaagttgtgttaaagccttaaaaaacggaggttacagaaatggaatacgccttacacgaagtgcttgaggttcaggaaatgactgcatttaagacactttgtttgacgaaatctaaaacaatgaaagcactggtatctgatccgaagctgaaagaaatcatgcagcaagatgttgatatcaccacacgccagttgcaggaatttgcctctattttatctaatgcaaagcacgaatgaggagatgaataaatcatgaatcctatcatagaatatctgactggcatgaatgttctaacagaccaaatcattgctatggacttattaatttcagcaaagaacggagtcagaaattatgcgatggcagccactgaagccggaacacctgaagtaaaagaggtccttatccgccatttggaagaagcactcgatatgcacgaacaactctcaagctatatgatggaaaaaggctggtaccatccttggaaccctgacgaacaagtcaagctgaatttaaaaaatattgatacagccattcaattgccaaccctttaacatacaatgactgatttgctgaggaacagtattgattggccacaactgttcctcagcttcaaaatgagcactgtttgttcgggtcctatgaccgtaaatagattaaccgcttttctccatctgatctccgataatgtttgcaaattctccaatccaaataaggaatcgtaaccacctctttttatgcgatctcttgatggagaaaacaggccagaaacaaaatccttcgtttttgacctgccctcttcacacgcaaagaatgctaccttctttgctccactgatccgtgaagactttccgttttaggcctgcttttgagttttgcctcgttttcgcgcaatttcccatcataatctttaatttttgtgtctaatcttttaattgtttcatcaatttctttccgcttctctatcagccgctgtcgttcgtcagccaggatattttttcgagcttctactgtacggtcaccttcggtaaataatgttgtatattcaattagcgcttctatcgatagtcccgcatttcgcatgcatttaatgaattcaatccatttgatatcttcttcatcatagtcgcgaatgccgctgttttttcgttttacaggcgggattaatcctacacgttcgtaatatcggagtgttgcggctgtcaggccaaactgctttgccacctgagcaatattcatgatcttcacctctctatcctgtatgttgtgaaggtaacacttaaagttaactttaagtcaagctcaaaacaagtggttagctgctgaatctgggtttatatattcgggacttgccttaaagcacactttaaactctatacttctccatgcactaaaaacagtgtagttggagggattgttgaatggcaaataaacacactgccggaagagaacaattaggagaatttgcgccaaagtttgctgaacttcatgatgatgttctattcggtgacatttgggcaagagaagaagaactttcatcccgggatcgcagcatgattacagtttctgcattaattgctgactgtttctcagcttataaatcaggttcattttaaatggtttttaaaaaaaacccttgccttaaagcagactttaaggtttatcgttatgttgaagacaccataaaacataaataagtgcatgtttttatttacaacacttatgatgaagaaaggataggttcgtatgtgtaatcaacatcaaacccgtgtattaagcgtgtcacatgcaaaagccaaatttgaacaaacgacgattgagcgaagaggattacggccgcacgatgtcttaatcgatattaaattcagcggtatttgccattcagacattcatagtgcttttgatgaatggggcggtggcatcttcccaatggtgccaggacatgaaatagccggtgtcgtaacagccgttggagcagaagtcaccaaatttgctgtcggggaccgcgttggtgtcggctgttttgttgactcatgcggagaatgcgaatactgtctaaacggagaggaacagttctgcacgaagggtgttgttcaaacgtataactcagtagactacgacggaaaccccacttatggcgggtacagccaaaaaatcgttgtcactgacagatttgttgttcgaatcccagatcgtttggaaatggatgttgccagtccgctgttgtgtgcaggtatcacaacatattctccgctgaaacactggaatgttggcccgggtaaaaaagttgcgattgtaggcgtgggtggccttggacatttggcgattcaatttgcacatgcgatgggtgcagaggtaaccgtcctgagccgttccatgaataagaaagaggaagctctagaactcggtgcaaatcattactttgcaacaagtgacccagccacattcactgcattggccgggcgttttgacgtgatcttaaatacggtatcggcaaatctcgatgtagatgcctatttatcaatgcttcgtatagacgggacacttgtaaacgttggagctcctgccaagccggacacatacagtgtgttttccctaatcatggggcgccgcagcattgcaggttctctagtcggcggaattcaagaaactcaagagatgctggatttcgcagctgagcatggcatcgaacctaaaatcgaagtcatcggagctgaccaagtggacgaagcatacgaacgtatcctccgaagcgatgtccgctatcgatttgtgattgatatttccacattgtaataggttaatccttatatgggctgaaccgcttataatgaaactcacgaaaaacgatctcgttaagcaaatattttgaaggccggtcaatcttcctgttattctatgaatagagagttattaggagggttttttatgagcaaaaaaattgcagttcttgttacagaccaattcgaagacatcgaatatacaagtccggtaaaagcatacgaagaagctggctacagtgttgtggctatcgatttggaagccggcaaagaagtcaccggtaaacatggcgagaaagtaaagattgacaaagccatctctgatgtggatgcaagtgactttgatgcacttctaattcctggaggattctctccggatttgcttcgtgcagatgaccgtccgggtgaattcgcaaaagcatttgtcgaaaacaaaaaacctgttttcgcaatttgccacggcccgcaagtactgattgatacggatcttctaaaaggcaaagatatcacaggctaccgcagcatccgcaaagatttaatcaatgccggtgcaaactacaaagatgcagaagtagtcgtcagccacaacattgtcacaagcagaacacctgatgatttggaagcatttaaccgcgaatcattaaatttgttaaaataaaacgagaaggcacagactgttcaggtctgtgccttttttaaaattaagactccttcgttacattctgaaagacagcagtcgcgtcccacacattcaagccaaattggccttctgaaaatgcggaatcatgtgcatcaatcacaagatgatcatctaaatagattttaaagcgatcgccctcggcctctgttttcagatgatactttttattaacgtctatcggtgttttgtattcagcaatgacagaagcagcaccgttctcaaatttaaagaatttcactaggtcatgcttcgcatccacattggcaaggtaaccgtttttggcatctttgtcagagcgaaacattagtgctcctgcccctcttccgtttccatccttaatggtgatatcagattcataagtgaagtctgacccggatgctgaagacaagataaaggaatctccgtccgacctcccttgtttcccctcaattgtgtcggcccacgtgccatttacagtcgtccagccggtcaaattggacataaaaggtgacgttccccatacctttttcaaagggtgtatcgttaaagattttacctttacaccgccatttgcagcatataattcaagccctttgcttgatcggtctgggagaataatatccgttatgacctgctttccgtcattcccaaatacttcaaccgaagagcggtcaacaaaaatgcgcatcttaaccttcccatttaccggcttcaatggggctgtttcttttccggtgttaaaggccggattaaaggtgttgttgcccgactcgctccggtcaacgaacaatttggcgttccttcggtcatagccgaccttcgtaaattgattttcacctgttcggaccttaaaaccaaattcagcagctgaaccagggcttactttaaattctgcatttatttcataggcatctccagattgccctgctaacacattatgacttgcaggcgatatggtcagattcttccacttcttagaggtcccgcgaatggtttccagctctttcactggtgtttggaccactctaaccccttcggtaaacgctttcaattttaactctcttggaatggacgttgcacttctccatggggatgtcggaacatcattcgcatattgccaattgctcatccaccctaaccatagccggcggctgtctgttgatggaatatcggaccaggatacagccgcataaaagtctctgccgtaatccgtccagagaactttgtctgacgggttttcatttttaaaatgagttccatcaaagtcccctacaaaatattgcatgcctgatcctcccgagaccgctccgtttccgacactgacctgcatgacccatttcttttgattcggattgccgtctaccggaagctcaaataaatccgggcattcccatactcctccgtggcttccttgatcctgaccaaattcacttgcatacgtccactgcttcagattttttgatgtataaatgaggatacggtcaccggccgcaagcaccatcacccactttttttctttttcataccaaaagacttttggatcgcgaaaatcttttttacccgggtttggaatgacagggttgccagcgtatttcgtccatgttcttcctttgtcgttgctataggcaatactttgcacttgatggccttcctgatcctgtgtataaatggccacaagcggcttctctttgcctgtttgaaaaccgcttgtgttatttttatctacaactgcgcttccagaaaagatcgtgcctttttcatccggatacagcgcaacaggaaggtgttcccatgtaaccaaatctttgctgacggcatgcccccaatgcatgggcccccactgaagcccgtatggatggtattgatagaacaagtgatattccccggcataatataccattccgtttgggtcattcatccagtttgcctctggtgtgaagtggtattgaggacggtaatcctcatcatagtagcttgaatcggctgcatctgccgaaaatgccatagtcaacagcagggtgaacatgatcatgacttgaataagtctctttttcatttgttccttcgctcctctcttcatgtttgaacactttaaagagagactgctaagcaagctggtccgtttctggcaattctcctctgtttcgctgttatccgaatgatttatatatgagaagactgctgcagtttctctctttttccttcacacaccttatgctaagaatccagcccaatacccgagaatcccgatgacaaagatgccgcaaataatgagaagaggattcacccctttgcgaagcatccatgccaccaataacgttaatccgagaggcagcgcacccggcataatgctgtctaacacgttttgtacagtttgaacatctacttttccgctttcatccttaatcctggatacaacgattggaatgttgatggtggtccatttggacacaagagcccccataacaaataacccgagaatcgaagcgccctctgtaagcttttgaatgcgattccccgctaaatcctgaagaatctccattcctttcacatagccatactttaatccataatattttgtgcttaatcttatggcattcagcaagaaaaagaatagcaaagggccagcaatgtttcctcctaaagcaagggaggctcctagcgcagctaagacaggacgaatcgttccccagaaaattgggtcgcctacgcccgctattggtcccatcaaaccgattttcattccgcttatcgcttttccgtcaattcctttattgttcgccatttcttcttccatggctgccgtcacaccaaatataggcgctgtcagccacggatgtgtattaaaccattccaaatgccgctgcaaggcttcgtttcttttcgctccgggaccgtacaattttttgatcgccggtatcatgacataacaatatcccattgcctgcacacgttcgaagttaaaggaaccgagtaaaaaatttgaacgaataaacatgctgaaaatttcttttttcgttaatcgtttttctttctccattttttcttcccccctcatcgtttaggcatcaagatcatcatcgtcatcataaacagcaacactgccactgtctgatgcggccgcgactgctccgtgagcgctttgtttttgcatcacctgctggtataaaagcgccagacagagaccaagggctccaaatcccactaagttaaaatcggtaaacgccgctaataagaaaccaatatagaaaaatggctttaaataaggaatattcatcatattgatcaccatggcatacccgacaaccacaataatgcctccgcctatttgcagtccttttgtaatgacatcaggaatatttcccaggaacgcctgaacagcgctgacactaattaaagcaacaatcaatgtaggaatcatgacgcgcaaagcttgaaacaccatcgcggtaatatgcataatttcaattcctcttatatttcccgcttttgcatattgatcagcgcggtggatgaaaaagacagtgatcgtccgaacaaaaatcgtcagcgcctgacccgcagctgctaaagcaacagcgacagcaatcccttcgccaattccctgatcagcggtaataactaaaatggttgagatgacagaggcgatcgctgtatcaggtgccatggcaagcccgacgttcatccagccgagcgccatcagctccagtgtgcctccaagaataattcccgtttttaagtccccgagcaccaagccaactaacgtacaggccacaagcggacggtgtgtctgcccttcatccaatacacttgcgattccggtgattgctgcaatgattaacaacaaaataatttgtaatgaagacatattctcatccccttgattattttgttacgttccgtaaaatctgtacaaaatcctcactggcatctgaaggcagctgcctcaattccagtttcacgcccttgtcacttaatgtttcaaatgcctttatatcttgttctgtgacactgactgattttgtgatttgcctgcggtgattttcaaaacgcattcccccgacgtttacggttttgatcggtacacctgcttctataagagatacaatatcggacggattttcaaacaagagcattgctgttacgccttcgtagcgcggactatgaaatgcttttgccattttagaaaccgagacggcactcgcctttacatttgaaggcgcaacagaaaggatcagcgtttttctcatttcgtcctgagcaatatcgtcggagacaacgatgattcggtcggctgcatggacttttatccaccttgtcaggatttggccgtgaataaagcggtcatcgattcttgctaacacaatgttcatcataattcatcctctcttgtatcttgattggctgtttttactttttctaaatgttcactgcacacttgaaagctttgctgactcattgcttttaagttgttcagcaaatctttgagagccagatgttctctctggcttaatacctccagcagaatcggcaggtttacgccggctgccatatccattctttgatcctcagcaataaaggaagctgccgcgttatatggcgtccctccaaaaatatcgactaaaaaaagcacttcatgttcttccgggatatccttgagcgcctgatgatatttttcttgcagcgtttgtattccttcccctttaaaaaacggcactgcaatcaggttattttcttcaccgaatatcatccctgaagattcttttaatgctatgggaaaatctccatgaccgctgataataactgaaatcatatctattgctcctttcctgttttgtacatccatatataatgcaaggatcgtgccaacacagttgtgttaagcgttttcattgttatttcagccaatcgcaatttgttgttgaaacacttaaaacgaaaaaaataaacctgtattaaaatggtgttccatttaatacaggttcatatgaaaaaactgtttttaaaacagctggccatgcacttcttcagcaaatatggcggctataaataatttttcatcatcacttatgcgaagtccgagcttttcttcataaggggctaatgttcgctctgtcacgtacaccatttccttcagctgatcattgatctcttcttcctctgagaaagcgatcggattttgcttaattaccctttcaaaggcgaaagccgtgtgcataatgactttgatcaaaaccgcattattgaaaatgacccccagctcatcttgaacggtttgcagccactccaataacatttcgatcacatgatggggattcaagaagacaaggtattttttcaggctatcctcgcaaagctccctgacaatcatatttgcttcgttcaatccattgctcaaggggatgcttccttttgtaatcgcctgttgaatcagcttctctccctccccttcaattaacacttctaaagatacatgcggagcattgattttagggtctttcgttccgactgtcgcaaggatttcatactctttttcgatttcttttatgctgttggccagcttaatcgatgatacggtcaatatgtgaatcggtgtatcggaggccttgtttacgatcgtggttagaatgtcttccagctttttggccgtcccgctccccgtggtgcagatggataccaatgccttctttttgccgggtgccgctggctgacgctcccacaactcgataaaatccttcgtgaccgattgatagatcgcatgcaaatttaaattcaaatagttgacctttctgacagcatccagcaccattgaagtcgtaacattgctgatcgttttaatagagatgcctgtcttttcctccagcctgctttccagcattgcaagcgaccccatatctaccagcattaaaacaccttcgccttcatcaacctgtttcattttttctgctacgcattcaagaatgtccgaaggtgaaacagtaagcggcatgtcaactgctgcaatcggcgtactccccagcagttctgtcgcgacttcaaccattgaactcgccgtgctgtttccatgagcagccacgataataccgactcttttgttctcctttaacgatttgatggaatgaattaacatcgttaagtagatgacttctatttcaggaatagccactttaaaatattcctgaattttatctttaaaaatcatcgccacccgatattctttcacatgggtatcacgaatttcatctgtctcctgtgtattcaaaacatcaatttgctttcctcgctttaaaaatgcgtcaatatgcatactcaagaaataaataaacttacggtcaaatgtgcaatccagctcatgttcagctatttcttttaactgttttgtcatttgaatcacatcatcttcaacgaatgtcagcaggttgtctttttgaaaagcttgatgatgaaaaaaacttctgacatgcaaatggacatcagtcaagatgtactggttaatatcctttttggataaaccttctttcataagcgttttcactttttcctcaatcaaatgatataagttaaatgagaggtcttcgtcaatttttgttgtttcatcttctacaatcggagagataatcgttgtaatattgacatattcagaaatggctttgcttctttgcatgtttttgctgctggacatccattcttgcttgatttcatcaggcagatcgcgaacagtcagttcaataacttcatttctgtcaaggttatgcaaaaatccgtgtgcgcaaactaactggacatttgatttcagctgtccgacattcccaaatttcgcagagtgaataagcgcattatagacatcgatatgcacactcagattcttcttaattcgctctgcttctttccctaataaaaacgtcgtcagatccactctttctttaagcgatcgttcttcaagcgaaggaatatgaatggtcattgggattcttcgcaaaaacgttttcaatagtgcagaactcggattttctgtagtcgcacaaataaacaatacgttcgatgttcgtttatgttcagattctccaagcctgttataagaaccgctgtcaataaaataaaacagcatttcttgtccctcgggagggagacggtggatttcatccataaaaagaatacccccattggcctgttcgactaaacccgccttatcctcggcagcacctgtaaatgaaccttttttgtgtccgaataattgagaaagcaataattgaggattgttgtagtagtctgcacagttaaatgtaataaatggtgcgccggccttcaatatgtcagagtaaatggcaaactggtaaattcggttcgcaaaaagggatttaccggaaccagtcggccctaggaggagcatatgcagaccggtcggcggataaaagacagctgcttttgcctgggagatcgctttcttcaaactcccttttgcccctatcataagctctaggggattcgtggaaatgtgttgatgattttgctttgaatttccggaaaacgcctgaaggtctttcacttccatcatctctgtatcccatttcttgttgaatgatttttctgctatctcgactgggatgtatcttacaggaaacgttttaattttgatgacctttttggaccggacgagattgttcaattcaaagctgacattggaccgctccattttcagctgctcggcaatctcctttgctgaattcccttgtatttttaaaagatgatctaaggttgaatcatgaaaattatgctttagctgatggtatattttatctattcttctcacgtctatcatcctttgtccttattagataagccattaacaagaatatttcgaaactttatagtccgcgttgagattatctgctgatacacgtttaaaaaggtctctatagcaaattgacaaaactggcttttatgcgtatatgtttacattttgaatcatttgcatctcatattagtatgatagatgctcagttctggagggccagtccccttcaaaagtaataatcagtaaacagtttatcattctcggggaatgtaatgatgtcaaaatcatcaatgacaaaaaatgaatcttatagatcatgacaaattacccaaatataaccccttaagttcgctcacaactaaaaagacggacacaatatgtgaccgccacagtattacaatttgcaaaacttcgtcatttttgcaatccactttgaaggttaagaaatctgtaagcttaaaaactttatctccgattctctcgatttgatcccccctgcaggtctcaaacatagtgggtatgcaattatacaaatcgttactgattaaagctagcctgtcagattgtccaaatgtctttcctgttttactctgctattcaggtagaatcacgagtgaaaaatagagccagaagacatgtaacagcacttaaaatagttttaaaatttaaaaataaaagtatctattcttttaaatgttataatatccgataaaactttactcatctttttattactggaggaaaataaaattgataggcaattctagcaaagacaattttggccagcaacagaaattgtctagaggccttaaaaacaggcatatacaattaatggcgattggaggtgcaatcggtacaggtttatttttaggttcaggtaaatccatccattttgcaggaccatccattttatttgcttacttgatcaccggcgtattttgctttttcattatgcgttcgctcggagaactgctcttatcaaatgcgggataccactcttttgttgattttgtaagggactatttaggaaacatggcagcatttatcactgggtggacctactggttctgttggatctccctcgcgatggctgatttaacggcggtcggcatttatacgcaatattggcttcccgatgcgcctcaatggctgccgggtcttcttgcgcttattatcctgctgatcatgaaccttgccaccgttaaacttttcggagaattagaattttggtttgcattgatcaaagtcattgccatactggctctgatcgtaactggtattttcctgattgcgaaaggtttttccgcagcttccggccctgccagcctcaccaacctttggagccacggcggcatgttcccaaatggatggcatgggtttatcctatcgttccaaatggtcgtcttcgctttcgtgggtattgaacttgtcggactgacagcaggtgaaacagaaaatccccaaaaagtgatccctaaagccatcaatcaaatccctgtccggattttacttttttatgttggcgcacttttcgtgattatgtgtatctatccttggaatgtgttgaatccaaacgaaagcccatttgttcaggtcttctctgcagtaggcatcgttgtggctgccagtttgatcaattttgttgtattaacatcagccgcgtcagctgcaaatagcgctttattcagcacaagccgaatggtctattcacttgcaaaggatcatcacgcacctggactattaaagaaattaacttcttctaacgtgccaagcaatgcgctgttcttttcatccgtcgccattctgattggcgttagtctgaattatttaatgcccgagcaagtcttcacactgattacaagtgtttctacaatatgcttcatttttatttggggcatcacggtgatttgccatttgaaatatcgaaaaacaaggcagcatgaagcgaaagcaaacaaatttaaaatgcctttttacccattatccaactatttaacacttgcatttctcgcgttcattcttgtcatattggcactggcgaatgatacacgtattgctttgtttgtcaccccggtctggtttgttttattgattattttgtataaggtgcaaacccgcagaggacataaggtgaaataaaaaaaagacaagggatactcactcccttgtctttttatatgtgtcaaacactaaattaaactttggtttcaaatttcattcacttcatttaagtgttaactcaaaccagttttgatgccgaaacctactaatattattccggtaattttttgaaacactttctggaacttcgagtttttcatccatttttttgcgtaatcaataatataaacaagaaacaggaaccacaacaccgctaataaggttaggattgaagctaaaatgatgagctgctggtttatatttccgttcaaattgataaattggggcatgattgtaacatacaccaaaacagttttaggattgagaatgttactgagtgatccctgcataaaggaagttttataataacgtttcggagaacttgccatattttttgcttgggattgcatgtcatctaacgaaaacatacttttagcaaaaaaactttttacacctaaataaattaagtatgccgctcccaaatatttgatcgttgtgaaaagaatcactgactttgcgatcaccactgataatcctaaaatggcaatcaccgtccaaaaggaaagtcctgttgccaatccgagaatgttataacggccggctttcgggccatacctaagcgtatttttcatcacaagcatcgtatctgcccccggtatgataaccatcatggcagcgatcggtatgtatgcgagtaagctgtgcattgttctctccccctttaaaaatcccctcaatcatatagtgactacaaaagtaactacttataaaagtgtatcaatgcgtttggaataaatcaatatggtttgttaaaatagcgattactaaggcagcgattgctctttatattggaggatatatgaaagaaaatatgttagacattttaaaaaacctcaattttacagaatatgaatcgaaagcgtatttggcattattgcaagaatcacctttaacaggctatgccgttgctaaaaaatccggagttccccgttctaaaatttatgaagtcttggaaagccttgtcataaggggagatgtttttgtcagtcatggaaatacgcctcagtatgttcctgtccccgcaaaagaactgattaaaaaccgccggctcaaagcggaagagcattttgatcaggctgagaaatattttgaaaagttcgagcagactgctaatgaccgggaaaacatctggaatatcaccggccgcagtgaaattcttgaaaaggtgaaggcttgtatcttatctgccaaaaaaagaatcctcttagaaatatggaaagaggattttaaggagatagaagcagagctcaaacaggcggcagaacaaggcgttattgtcaccattattgcgtacggagacatcgtatctgattttgccaatgtttatcttcatgatatgagcagtgaaattacagaagagtatgacggacggtggcttgtctatagcggagatgattcagaagtcgtagcaggcattgtctcacttggcaacgacagccgtgctgcatggacgatgcatgtaggtttagtcatgcctattactgaagtgatcattcatgatctgtacctcatggaaattctgaaaaagcatagagagcttttagaagagagcttcgggaaaaatctcatccagttgcgccgtaaattttctatccattcagatttcaaaaaacattatttggaataatattcgcatcgcttaaccaaaacaaggcttgtacaaaacaagccttgtttttttatgcataacccccccatgctgatttacttctctcttttaaaaaaatgtgattctgcgcaaactatttttcagcctgccgcgtctatcctaggtaacagcctacgatatacgtatattcaaaaaggagccctttattgcaatgaagaaaaaacaaacaacaaaagcgttgcttgtcacatgcataactgaccataagcaagatttctacaggttggctttcagttatgtgaaaaatcaagatgacgcattagatattgttcaggaatcgataaaaaaagcgctgagctcagttgaaacggtcaggaaccctgagacgataaaaagctggttttataaaattttagtgcggacagccattgattttttgcgcaaacaaaaaaagataagagtgatggacgacgaaacgatagaatttttaagcaaaggaaaggaagaccattacaaggatactgatctccatgaagcgcttgacgaattgccgtaccgctataaaaccattattattttacgtttttttgaagacctcaaattagaagaaattgcggaaattacaggagaaaacacgaataccgtcaaaacgcgcctatacagagcattgaagctgatgcgcattcagttgacgaaggaggatctttcttaatggataagagattacagcaattaagagaagaatataaaaatgttcagattcctaaagaattggatatcattgttgaaaaagcccttcagcaagaaccaaaaaagaaaagaatcgtcatgtggccgacatcagcagcaatcgctgcagctattttattcactgcgcttgttaatatcaacccggacgccgctcaggctatgtcaaagatccctgtcatcggcaaaatcgtcaaagcgatcacctttattgaaatcaaagaggaaaaagaccaatcaagcattgatgtcaaaacacctgctttgtccgggctttctaataaagagcttgaaaacagcattaaccagaaatacttgaaagaaagccagcagctgtataaagcgtttatacagtccacatccaaaaacaaaaaagggcatctcagcatctacagtgattacgagacggtcacagacacgccagatttactctctatccggcgcaatattgaaacaacacaagcatcttcctacacacaaagccgttatattacaattgacaaaaagaatgatattttacttacattaaaaagcttattcaaagatgagcgctatatcaaagtcatcagtcaaaacatcaaagaacaaatgaaacagcaaatgaaggaagatccaaataaaatatattggctcactgacgaagatgcagaaccgttcaaaacgattcttcctgatcagacgttttacattactgaagaccataaacttgtgatctcatttgacgaatatgaagtcgcccccggctatatgggcgttaccgagtttacaattccaacccgtgtcatttcaaacttgctcgtgggagaacgttatattcgataaaataaaaacatccatctaagattatggatgttttctctcttctctattcgaggtcgtaacctcgctatcaaaaacaacgagaatatttgcatactattggaggaatacccatgtatcacaagacacagcatcatcgatacatccctggacttgatggccttcgcgcttttgccgtcctgtcagttatcgcttatcacctaaatttcaattgggctaacggaggttttatcggagttgatatcttttttgttttatccggatatttgattacatctattctattaccggcatatggaaatgatatcaatcttgattttcgggacttttgggtgcgccgcattcggcggcttctgccggcagcgtaccttatgatcttttccactgttgtgtgggtcgtattgtttgatcgagaactattgcacactgtacgtggagatgcgatctcttctctcttttatatgagcaattggtggtttatttttcacaagctatcatattttgatagtttcggttccccatcacctctaaaaaacctttggtcgctggcgattgaagaacaattttatatcatatggccgatgtttttagttgttggaatgtacataatgaaaagccgcgccagattggctgcggtgatatcattgcttgcgctttgttcagccgtgatgatgagcgtattgtatgaacatggcggagatccgagccgcgtttactatggcacagacactcgttcgtttgaacttctcatcggatgtgccttggctttggtatggccgatgaaaaggctgtcttccaacaggctgccaagcaaactgaagcacactttgcacgccactgaatttttggcattttgtattttagtgttgtgtgtctatttcacagatgaatacgagccttttctttacagaggcggaatgctattcattagcgtgactgccgcaatccttattgcatgtgtttgccatccgagcagctttttaggcaatctgctttcatggaggccgcttcggtggcttggaacgaggtcttacggaatttatctttggcactaccctgttattgtgttaagcacgccagttcaagaaatcggaaaccctgttttttggcatatcgtgctaaaggtcattgtgacatgtatacttgccgagctttcctatcattttattgagaagccgatacggacacagggatttaggtcatttttccgtcgtgtttttatacatagaatcaaggaatggaaaacgacatctgtcatcagcaaactgtcaattggtttcattattttcgctatacttatttttgcaggcgggctgtcagggctagccggcgagcaaaaacaccctaccaaatggacctatagctcacaagaaacaaatgctgactccagccaggcttctggggataaaaagaacgctgcagcagataaaaaacactatcctgaacaaaagacaacagaatccgatcaacgtcaaaaggaaaacaaagatagtgggcaagagactcataaaaagaaagacacgcaatcccaacagcagaaaaaaccagcagacactgcgaaagaagttttagctataggagattccgtcatgcttgatatttcttcacacctgcgtcagtcactttcacatgtgacgattgatggaaaggtaggaagacaaatgtctcaagctttggaactcgcaagggagtacaagtcttttaatcagccgaacaaggctgtcatcattgagcttggaaccaatggctactttacaaacagccaaatcgaacaactgcttcaatctttctcaaaagcccatatctatcttgtcaatacacgggttccccgccaatgggaaagcaaggttaatgaatctttacagcaccaggcaagcgcacatcaaaatgttacgttagttgactggcatacagaagctcttcagcatccggaatattttacccctgatggtgttcacttggttcctaaaggggcaaaagctttgaccgctcttattgttcaggcgatgaaatcataaaaaaagagatcctatgcggatcactttttcactttagtttctgatcgttgattatgtctcctttcagcaaggctgcccttatgtttacattccgtttacgtaagggtaagccaaaatagaatggagggatgatggtgacagtaaatgaagaacatgacttccaaaaagagctgaaacgatatgaactttttttcaaaaaacgatataagattctttatacagtaaacgattttatcattggtgctttgtttctcgtcgggagctttttctttttttatgaccgattaatgtcggcagggatatggctgtttgcgatcggaagtttgctgctgttaattaggccgaccattcggctgattcatgactttcattaccgtaagcatgtggaacagcaattcaagcatcaatcttcaacagatgactgatcttaaggaataagcaagaacaaaatgccaaaagcctgagttgaaaatcaaaaacaagacttttagactatttatttttaaaaataaggtaaaaagaactaaacttttgcctctgcatgccgatatgaataataaggccggcacgatactccctataacatccttttcagtagatttcattatcgtgccggttttctcatatgcaaagcaatcccgccaatcagattggcgggattttatattttacattcctgtccaaacgtctttcacataacgtctttgatcttgcagcttttgcagccattcagctgattcttcctgacttgctcctttttcagcttcatacgccaatcgcaaagtcttctctacatcaggagccatttgtgatccatcaccgcatacgtaaatatgagcccctttttcaatgagtgtcatcaatttctgcgtatcttgcttgagcaagtgctggacatattcttttggttcgtttttgacgcgcgagtagcatcggcggattgtgaccaaaccttcctgttccgcttgatccagctcttctctgtaaaggtcgtcatggtccgggcggcggcagccgaagtataaaagtgcttcaccaagggtgcttccttccttcttcaaaaccgatcttgcctgaataaagcccctgaatggcgcaattcctgtgcccggcccgaccataatcataggcgtttcaggctcatccggcaactggaatccggactgcggcgtacgaatgaagcaggctgctgcatcacctgtattcaactctgctaaataattagaggcgacaccccggtattcacctcggccgctccatgctgaggctttcacaactcctaccgtcatgctcacgatatttgcatgaactttcggtgagcttgaaatggaatagtatctcggttttagtgatggcaaaagtgctaaaaaccgttcaaacggcatttcgcaagcaggataatcctctaaaaaatcaagcatggtaagacgttttgcaagtacctgctctttgtaaatgccatcatctgaaacgagctgttccagctctttttgatgcggcggacaaactgtataagaggccagctcccgaagctgaagccttgatgccggttcctgcagctctacataggacgacaataaatccactactttgatcggccgatccatcggcagatgagccatatgagcgcttccgcttacttttatcacatgattggactgcaaaccgaatcggctgagaacccgctgaacaagctccctgctgttcttcggcaggattccgatatgatcgccttctttatatgttttaccagccggaatttccaattcaatatggcgggttgaacgcgtgctgtcagctgtctggagttctcgattctctaacacaaccccttcaaacgcgccatatgctttagcaaccggcgtttccgtcgcttcactgagaaaagtaatcgataatgaaggcctgtcttctttctgggctatttcgttaatatcaaatgcgtccatcgtttccttccagaagcggttttcccaagactcgcgatggctttcaaaatcatcggcggcgtcaccttccccaatcgctgttaaacgcgatgccccctttgctttcatcatgtcatcaatcaggcggggaatccgctgatacgtgctggcccagctccggttcccgcagccgaataccgcataggaaacacctttcaattggccttcctcaagctctttcagccactctacaaagccggcagcattatcaggcggcgacccattataagaagccgttacaatgacgactgccccttcttcagggagcttgccgatataatcatcaagcggagccgtttcagctgtaaagcccatctggcggccttgagcagccaattcaccggctattccctcagctgtcccaaggtttgaaccgtaaagaacgagtaaaggtgtgccgtgtttaggtttggtttcttttggctttgtttctgctttgatttctgcctgttcttttctctgtacattgattgccgctgttttccgcggtttcacagtaattttaaaatcatccggcttgatcgttaatgcttctttgatttttagttcgtagccagtatggttaatcaattcaaaatgctttaatacaagaccgagaaccattgtcgcttcttgaagagcaaactgcatgccaatacaagcgcgctgtccgtttccaaacggcttatacgcatggtgagggatacttgaaggatcctcaaaccgttccggacggaaatcttccgcatccggcccccaagcgttttggtcccggtgcagttttggaattaaaacagtgactggctgccctttgctgatcggatattccccgcctagaacagtatcctccttcgcatatagagaaaaagccggagctgttggatacagtctgagggtttcatttaaaaccatccgagtgtatttgagctgctggatttgtttatattcaggcgtgtcatccgttaacacgcgatccgcttcctcctgagcttttttcagtttttctggatgtgtaagcagacaataaatcgcaaaggaaagcaaaccgcttgttgtctcatgtccagcaattaaaaatgtgatgatttgataccttatgttttcatcatccagcgtttcaccggttactggatctttggcataaagcatgagagacaagagatccttgatgttatcatccggattcgcctttcgctccgctatcattctatcaaccagggagttcatgacttctatatccttttgaaactgcagcttcgttttcaccatcatcttatcttgcaggcccagtctttttgattgattcatcgcctcttttaaggcacggagcatactggtgataaaaggatgctgtgaatcacggtaaaagctgttgaatcgatagttaaacccgcacaacccaatcgtatcaagcgtcagacgtgtcatatcgtctgctacatcaatttcttcattagggtttaaccggctccatttttgaatcagctgggttgcgatatccagcatcatagaatggtagcctttcatcgctttttgactaaaactcggcagcaaaatgcggtgggctttttgccagttcggttcgtgcgtccagcttgtaaataagccatctcccccgaattcgcgcaccttttgcaagcctttgccaaggttcttgtcaaagcggctttcatcacacacttcagccacaagattgtggcccgatacaaaaacactggatactcccggaaaatcaaaacggaaaatcggccccaattcatcagctatccgccataaggattgagaaagctgttctttttcaagatgcggaagattttttaaaggtccgtatgttttgggctgaggtattgcgcttgcctgtttcattaacatctccctttcctatttttgtgatgaatgaagcttaatggcgtcccagcagcattgttccaattcagtaattaaatcagtgtccatctctatatcacctgtttgaacgagctgatatatcttgagaaacgcccctaatacaatcgcaattaacacattagagggcaggctgcgaatcacgccttccgcttttcccttattaaaatagtcatcaaacatttgagtcagattttctatcatttttttgcttgtatgatttaagtaatgagcatcttttttggtttcaagaaaaaaaagcgcatagtcgctctctttcgtaaactgaacgagacagcaaaatacgtggtgaaagccttctctgacaggcaattctgaaacgtcttgcttcagtttttccgtaaatcgctggatgctttcttgaaacagcacgtttacgagtgtttctttgctgtcaaaataacgatagatcgttcctgtccctacatgagcacgttcagctatcataggaatggtggtagcgtcaaaacccctttccgtaaaaagtgagactgacgctttcataatcatgtcgtatttactgctggatgcggataacatgtaatctgacaacctccgattcgtttgcggaatgaatattcattccttttgttcacaaagaatgtctgccctgtctgaaatcacctctttgttctttcttctgttataagtttaaatgaaaaaaactttttttaatataaagtatatgcaaaaaataaaaaattaagaaaatatacccaaatccagatgtaagaatcttggatatatttcccgagaaattttttatttaacagccacaatacatagacaggaatcacgcctgataacagaaagatccctaaaatgctgatctttcagcagttgaatatacgttttctctttttcaccggtatttgtgtcaatactgatataaaaccggccgtcaatttgaagcaccctgtaaatttctcttaatgcaagcctaatatcggtgcagctctgaactgtatgtaaagaaaagactttattaaaggtacggtcatcaaagggaatgtcctctggatagccatgaaaaacctccccgttccccatattctttcgattcgcacgtgatatctgtcttacctttcgctttgaaggatcaatgctttttaggcttcccttttctagtttcttggttatgcttttaaagacagtgccatttccgattccaatttctaaaattctgtcattttcttgtatatctatagagtcaatcatcatatgctcaattgttttggttagcttatatttccgagaaaataatttccgaaaattggatcgtttatagagtctattttctagcaatttaaacacctgcttttggtttcctatgtttatttattatcttaaaaaaataaacatcatcttcatttctaaaagtgaaggaaggtaccaactagacggcaatgtattgaaaaatgtttcaatagaactaaactttttcatttttttccgcaaaaaaagcagaaaacataatgttttctgccctctttctaatgccaatgataagggaatacatacagcctttgctgctgcattgccatcagcctctgctgtcggaatggatttccataaccatgtttgaaggaatgcggcatggacgcataaccatggccaatcgacggcagtcttttttgataatcgttcatcatgccatcacctgcctcacaataacgttgatttactatatgcaggcgcgcattttcttgacagctatttcgctaaacttggtccttctccattgtataatgcatcaataattcccttctaagcatatgccattcccccttcagtttttttcgttgcttttagcgccagttcgttaaataaagatgctttaactgagactctttcatttcatcataaatctgctcaatctgctgttctcgttcgaattcttccaggcttttaaaccgttttttaatcgttaacgttaaaaagaataggttaatcgtcatatcgctcaccccctttcaaagtccgcatcaacgaaataacccgcggcacaacccttctgccgcgggcaaataaaaaccgcagacaaaagaagacaccaatgcctctactgcctgcggggagttgcgtatgtccgactattccgaatttaatgcgtgcgataagcatcggttaaggaaggacacgaactcttccacaggctgaataaatcatgaacttttacatgtgtatcacgtacaggttgacgtcgttgtctcattgtcattttggttcagcctcctttgcttttttcttactttgtaagtatatccaccaaattccattttgtaaacatctttttctaaaaatggacggaaattgtgcaaatcatcgaatggatttgcccgttggtcatgacacctgcttcatttcttttctggagtggtctttcttatgatatgcaataaaataaatgagaccgacaaatacagctccgccgatgacattaccgataaaagccggaatgatgtttccgatgaactgcccccacgtgaatgaacctgcaaaaatggcagcaggaatcacaaacatgttggcgacaacgtgctgaaatccgatagccacaaaagccatgattgggaaccagatgccaaggatttttcctgctgcgtcttgggcgccgaaagaaagccacactgcaagacatacaagccagttacagccgatggcggaaatgagaaccttgccaaagctcatatcaagctttccttgggcaacggcaatcgttttttctaaataaggacctgtttcagtcaatccaaccaaatgcccgaaaaagtaagcaacaaacaatgcgccgattaagttcataattgtgacgattccccagttaatcgctaactcttttactgatatttttctcgaaaataacgccatcgcaactgacatcatattgcctgtgatcagttcagcgccagcgagaacgacaaggatcaggccgactggaaatactgctgcaccaatcaaactggacaggctcccccattctttcggaagatcgccgattaccctgatatcaagcaaatacccaagcgcgataaatgcaccgcctaaaaaccccagcacaagcagtgacggcagcgggagcttgatttttttcatccctgcttcaattgctgcttccgctatttcatccggttttcgaaaagccataattaaacgcctccattacttcttcttttctgacagttatgcaagaaaggcaataaaaaaggcagcactcaaataacctgtgtcaaaccaggcgtttgaatgctgcctaacttgtatgcatacccatacaacaatatcaagcagtatataagatattgaaagagaatatatacagttcgtgcatacattccattgctttagccttctataactgtagcaacatcataacaaatgtgacaaatttgtgtcaatgacaaatatactagctttgcagaacttctttttgctcatctatttttcggtcaaaaacaaatacagatacagctatgttttcctcaattttaatatcagaaaacaaatggactagcttagctcccatgagttcctccattccttccggtgtttgtttggaataaaggtcttgaattaggcttgtccgggccgcatgtaccatctctcttccttcaggcgtgcgggcgataaactgctcgcttgcactcagatttccgtatagtgttgaaactgccatgttttctacaaatacagtatgaattctctcaggcccttttccgaacaattctttgcgaagttttcgaataatatcattgaattcatgaatttttttagacatgctgattaccccttccgatattgccttataaaggcttttcccggttcccctcaggacatttcacttggttaaaattttcctgccatattgtattataataaatatcacattataataaaagcagtgttgatggatttgtaataggatcttgttatgagtctatcgttttataaaaatcaaggattggtctgttagtaagacttgctagtgaactattccgccatgtgtgtttacaccttcttagaattaagggcaggtgtatctatacatggctttttttgacttcttgaaagaaagatggaggggaatatgaatatgatggacgttaagtcgatcagtgtccgtgtagacggaacagaaattcaagcacgagcaggggccacaattttagatattttaaatgaaaacggaattgagtacccgcagatttgccacgtaccagaggttgacccgattcaaacttgtgatacttgcatagtagaggcaaacggcaagctggttcgttcatgcgcgacggttgcagaaaacgggatgtctattgatctttcaggaaatcgagtgaaagaagcgcaaaccgaagcgatggaccgccttcttgaaaatcatttgctgtattgtacagtttgcgataacaacaatggcaactgtacgctgcataatacagcggaaatgatggggatcgagcatcaaaaatacccatacacgccaaaagaagatccttcttgcgcggttgatatgtctcaccctttttaccgctatgatccaaaccaatgtattgcctgcggccagtgtgttgaggtctgtcaaaaccttcaggtaaatgaaacactctcaatcgactgggaacgcgaacgccctcgcgtcatttgggatgagggagttccgatcaatgaatcttcctgtgtcagctgcggtcagtgtgtaacagtatgtccatgtaatgcactgatggaaaaatcaatgctcgggcaggctggttttatgacaggcattaaagaggacgtcatggaaccgatgattgatctcgtgaaaaatgttgaaccggggtatggcagcatttttgccatttctgaagtcgaagcggcaatgcgtgaaacaagaacgaaaaaaacgaaaactgtatgtacgttctgcggtgtcgggtgttcatttgaagtatggacaaaaggacgggatattttaaagatccagcctgtttctgatgctccggttaacgcgatttccacatgtgtcaaagggaaattcggctgggattttgtcaattcaaaagagcggatcacaaagcctttaatccgtaaaaacggagcctttgtggaatcttcttgggaagaggccctcgatcttgtcgcaagcagattaggatcaattaaagagcagtacggtaaaggctctgtcgggtttatttcttcttctaaaattacgaatgaagaaaactacgtcattcaaaaactagcgcgtcaggtatttgaaacaaacaacgtcgataactgctcacgctactgccagtctcctgctacagacggattattccgcactgtcggcatgggcggtgacgccggcacgattaaagatattgccaaagcaggtctcgtcatcattgtcggtgccaatccggcggaaggacacccagtgctcgcaacacgcgtcaaacgggcacacaagctccacggtcaaaaactgattgttgctgacctgcgtaaaaatgagatggctgagcgatccgatctgttcatcagccctaaacaaggcacagaccaagtttggctgatggctgttacgaaatatatgatcgaccaaggctggcacgatcaggcgtttattgatgagaacgtcaattactttgaagattataaagaaacccttaaaacgtatacgcttgattatgcagaacgcatcacaggcctttcaaaagaaaacatcattcaaattgctgaaatgattcgtgatgctgacggcacttgtgttctttggggaatgggtgtcacacaaaatacaggcggttctgatacatcagcagccatttcaaacctgcttctcgctacgggcaactatcgccgtccaggtgccggcgcttatcctctgcgcggacacaataacgtgcaaggcgcatgtgatatgggaacattgccaggctggctgccgggatatcagcatattacagatgacaaggcccgcgctaaatttgaagaggcatatggtgtcgagattgatggaaagcctggtttagataatattcaaatgcttcatgccattgaagaaggaaaaatgaaagctatgtatcttgtcggtgaggatatggcactggtcgattcaaacgcgaaccatgtgcatgatattttatcaagccttgatttcttcgtggtacaggacatcttcctgtcaagaacagctcaatatgctgatgtcgtcttgccggccactccttcacttgaaaaagacggaacatttaccaacacagaacgccgtgtccagcgattgtatcaggcgcttccgacgcttggtgacgcaaaaccggactggtggattattcaagaggtggcaaaccgtttaggagcgaattggaattacagccatccaagtgacattttctctgaaatggcgagtctttctcctctgtttgccaaagcaagctatgaggtgcttgaaggctggaacagcttcctatggggcagcttcacaggtgaaagcacaccgcttctgtatgaagacggatttaatttccctgacaaaaaagcccgctttgccctttctgattggaccgagccagcagcatttccggaggaatatgaccttcatatcaataacggccggatgctggagcatttccacgaaggaaacatgacaaataaatcgaaaggcatccaagcgaaagtgccgaatgtattcgttgagatctcacctgagcttgcacaagagcgaggtgtttgtgacggttcgcttgtacggctcgtttctccgttcggagcagtcaaattgaacgcgctgatcacagaccgggtacggaaaaatgaactctatctgccaatgaactcgacagacaaggagtcagcgattaacttcttgacgggccctgcagctgataaacggacgaacacgcctgcttataaacagacaaaagtccgcatggaagtgcttggcggctgtgaaacagcgccgcttccaaaaacaaatccgcgcaacaaaaaacggcatccgcaaaacggagtcgaagcagaaagaaaatggaaccgtcctggctatgtccatctgactgattaaacgataggaggaaaacgaatggccactccgattacgacgatcaaaaaagaaacaaaaacagctgagcaaattaagcttgaaaaaatagaagaactgaaagagctgctggcggaaaatgaggatgccgtctctaaaacgatgacgttaatgaatgaactcaatgatcttggaatttttgatgcggcaacaagcatgctcagagcgaaggaagacattgccaagattgcgcttggccaagtttcccgcgagcctgtcaccaacctcatcaacacgatgatggccgccggaggcgcattgacaaaagccgatcctgagtttacagcaaagcttttagaaagcgtaatggctgggactgaacaggcacaaagctttttaaaagaagacaagaaagtcggggttctcgacctgttaaaagcaatgaacgaccctgacatcaacagagccgtcggcttcggccttcagtttttaaaaggcatgggaaaagaacttcgagaacaataacagaaaaacagccatctcttgatgatggctgtttttttattcgtcggcttcttccaaacgcttcttgtaaataagtgaacggtcagcgcaaaagaaggcaccggctaaaaatacgcaatccgctaaaaacatagtcgatttctggcctaatgttaagccttgatcagggagaactgcgcctatatataaaaaagtgctgactgcaagcaatgtaaaagcaaaatgcttgtagtcttcttttaaagatttcattctatttttgttcaaaagaatcacctgccagattcatagtatacgactattataatataatccggcggcttacagagaaagtaattctatccatttgttatatattttcaagcgcttggccgatatcttccaacaagtcttccgcatcttcaattcctacagaaattctgatcaagccgtccgtaatgccgagctcaagccggcgttctctcggaatagaggcatgtgtcattcttgcaggaacagaaattaagctttcaaccgcccccaggctttcagcaatggtaaacagtttcagatttcctaaaaacgcatcaacccgttcttcactgccaatatcaaaggagatcatgccgccgaagcccgatccttgcgtttttgcaagctcatgtccgggatgatttgaagaaccaggataatataacgtttggacagcagggtgattctcaagaaagcttgcgattttccgtgcattttgatcgatcgcttccattctgagtcccaacgttttgattcctctcattaacagccaggaatcttgagggccaagcacgccgcctgtggagttttgcacaaaatgcagctcttctccaagctctttcgaagctgtcacaactaaacctccgacgacatcactgtgtccgccaagatattttgtcgcactgtgaagtacgatatcagcgcctaaagtaagcggctgctgaaaataaggagtgttaaaggtattgtctacaataagcagaacacccgctttttttgcgatatcagccatgagcgtcaggtcggtgattttgagcaacgggtttgtcggtgtttcaatataaatggcttttgtattagggcgaatcgctttttcaacttcttccctgctgctcgtatcaacaaatgttgattcaatgccaagacggttaagcacctttgtcatcacgcgatatgttccgccgtacacatcatcagtcaacacgacatgatctccgctgttaaacagcatcataaccgctgtaatggcagccattcctgagctgaacgcatagcctgcttccccgctttccagttctgtcacaagtgcttcgagagcggttcgagtcggattggccgttcttgaatactcgtagcctgtatgctgtcctgctttcggctgcttgtacgtgctgacttgataaatgggcacggaaactgcgcctgttttctcatcacctgtgattccgccatgtatcatcaatgtttttttcttcatatcagatgcctccttcgtatatttgtttgctgatatatcgatcgctgctgtcaggaaatactgtgacaatgttagttccagcggatgcttttttcgcttcctccaatgccgcataaagcgctgcacctgaagagcttccgatcagcaggccttctttttctgccgcttctttcacaagtctaaacgcattctcatctgttacggtgtagatctcgtcaaaatggctcttatccatataatcggggataaactccatgccgatgccttctgttttatgagcgtgaggctctcctccgtttaaaatcgagccctccggttcaacaatcaccgttttgactgctggatttttttcttttaagaaggaagctgttcctgcgaacgtgccccctgatcctgcccctgcgacaaacgtatgaatattcccgtcaagcgcttcccacatttcaggtccaagcgccttatagtaagtcgatggatttacttggtttttgaattgcaaaacgcaataagaattttcaatttcagtctccagctgaatggctttttgaatggcgccctgcattccgtcttgacgcggtgtatgaatgattgatgcgccaagcgcttgcataatttgctgtttctctctgctgaaatgttcagggacacagaaaatcgctttcagcccatattttctggcactcagcgcaaggccgatccctgtattgcctgccgtagcttctataatcactccgccgggtttcaccttgcctgaatcaagcgcgtcacgaatcagcatatctcccagtctgtctttgatgcttccccctggattcatcatttcaagcttggcatacaccgcgactccttctggaacatcaaagttcttcaagcggagaagcggtgtattcccaatcagctcggtaatgtccgtaatcactgtcatatatgtcctcctcctaattagaggttgtttttagagaaaaacggaggagaacgttctccccgttttaatgaattcgtttgatcacctttaacacaagctctgttgaatggacagccgcctgctctaaaaattggtcaaatgaaacatgtgattcttttcctgcaatatcagataacgctctgatgacgacaaacggcgttttaaattgatggcacacttgagccactgccgcagcctccatttcaaccgcgtacagatcagaaaatctcgcacgcacctcttcaacccgcttcggatcgttcatgaaagaatcgcctgttgcaattgttccttttgcaacctgaatgccgtcgagttcagataccgcttcttcagtgatgctaatcagcttttcatccgctgcataagcagccggaagacccggcacttggccgtattcatagtcaaaagccgttacgtctacatcgtggtgacgaacgtcagtggaaataacgacatcccctacattcaatgtatgatgaaatccgccggctgagcctgtgttaatgacataatcaggcttgtaacggtcaagcagaagcgtcgtgctcatagcagcatttacttttccaattcctgattttaaaagaatcacttcagttccttcgtattcgcctgttgtaaattcacagtgtgcgatcgtttctgtttttgcattttcaagtttgtttcttaagatggtaacttcctcttccattgctccgatgactgctagtttcatctattcacattcccttcactttaccgtttgatcgcctccattatccacacgaagtcgttttgctgagtgaatcggactgcaaaaccttcagctgtaaacatttctttcaacgcatccaatgtaggataatgctctgtctctaaatcatttgcaagctgataaaagccttgagaacgggctttatcgatagcctgttgatacgcttgcgcattttcaaagacggtatcggcaaacactattttatcatgcaagtgaaggtatttgccatatcgctttatggcagcccgcttttcttcgtcagtcaaatgatgaaaagcatatgaactgacaattgtatcagcctgaaatggcggctcagggaatgtcaggaagtctccatcaacgatttccgacctgcctgaaagcttgtcagaagccagtttacgcattgctggagaaggttcgattccaaatacagttttgcctgcatcgagcagcttagccgtcaaattccctgtccccgggccaaattctaacacatgcgttccagatttgctgacgatggcatcaaggatatgatcgtagcctctgaatgcttctttatactgaatatctaaaccttgtactgtttgatcataagttgctgcccaatcttcaaagagagggataaattcacgtcccatatttgtcacactccatatttaataattcctataagcatactatgaattaatgatggaacagttcctataataccacatcttctgaaaagcaggtactaaaacactttgtgtattttatgccatctcatattgcgtattgaccgcaaaaaagcttatacttcatatgacttgtgaaagctggagggtcaagacatgaattttcaattagatctgattaaagacaaagtggaattttttgaagccgcttcattgcaggagcttgaaaagaaaatcaatacacaaattgaaaacaataaagccatcatgctccgggtgaaatctgtttcacaccaaactgctgtggcagaaggaagaatattgtacagcgcggtggttcatttcgcagctgaagcctaaaacaaaagcagccggttgtaacccggctgcttttgtttattttagcttttctacttttgtcggcttccagcctttttcatcgacccatgtaatcgtgacttgatacttattcccagtcgccttgtccaaaatcttgcctttggcatcctgagggctgccgttatttccaagccagagcaccgtcatgttatctgttgagacaccagttgcgtacgaaatggctttcagcatctcagcccagtcttgcgagcttgaatcataagtagcggcatgctcgcctgtttgctcagttccgactgctttccagtcaggattttcatacgttttttccacatcgctcgatgagccgccttctgttacttttgcatctttaagcccgttaccggctgaatctgagcttgaatctgaatcagagtcatcttttttagaagaagaatcatcttttttggaatcagagtcagaagacttctcagaatccttttcgctgtcagatgtatctttcttgctgtcttttatatcctcatccgatttcttttccgtctttcctgaagccggagattcctgtttttgcgccgtttcagaatccttgctgacatctttgctagaaggactgttaatgaagagattcgctgctactacgacaattagtatggatacgattgcgattaaaatgttaagcactaaattggcttttctgcgtttatcacgattttcataacgagattgattattgctcaataattctgcactcctttatccctcttggctcagcatatattttaacatgtgctgagaagttgttctatttctgattgatttcaatttcgtgtacttttttaacaatatcataaaacaccgaatttgtcagagccttatcgcccggtgtatccatgtgtaaaacaaccagagcgtatttcggcttatccgcgggaaaatatccggcaaaccatttttcatagagcgtttccttctcttttgaaagcttgcctgtctgggctgtgcccgacttccctgctacagtatacggaagatcttgaaaccttctgcccgttccggaaggagattctaccacccgccgcagtattttttgaagctgctgtgacgtatatttgtctatcgtctcccctttgagcttctgatctttaaacgtaacgagcgttgtgccgttcttatactcaatttgttcggcaattttcacctgccgtttttctccgccgcgggcgattgtcgccatcatattggctacctccagcggggttacctttacatttttctgcccaattgctgtttgcgcaatggcttttttgactgatttgtctttttcatccccccaaatcacgccgcttttttcgttatacagctggcggaaatcggtttcgtggtacagttttccctcccagcctgcccgatcagtgagagccagcttctcggacatatcttcaataaccgagctgtcttttttcattaattgttctgcaagactcgtaaatgtgtaattacagctttgtgcaaagctttcatcaaaagacaaggttcctttgtcgtcccccggttccccgtacaggtttaaattgcaattaaaggtttgactaggcttcaccatattattttcgattgcagctgcggcaatgactgttttaaaaactgatccgggatagattggcgtcagcatataattttgaagtgtgttttgccgggacacatccgcatctggtttgcttacaattcccagaacactgctattttcgatgtccagcagcacagctcctccttttttcagcccctgttcatccaatacctcctccatcgctttttgaatgctttgatcgatcgttgttttgacctggagcggataaaatgtattggcttcagctgtatatttgacgtccatgccaaacaaagggtttccttttccgtccacatgatataaaagctttgtgtcttgttccggaagcaaaaactcgtcaaatgtccgttctaaaccggttgttccgatttctgttgtaatcggaaggctctccttgtcaggatatttcttgcgaagcagcgccggatcttggttcgtgctccctatcgtatgtgaagcaaggctgggcttgtcttcattctccatatatacgccgtaaatgccgggatatttcaaagaattgatttttgtgatagattgttttgaaagtgttttgattttcttttgctgcaaaatgaccggtttttttgccttacctagtgtctggcgcaaatcatcttcagacatgccgaggatgtccgcaacttttttgatcggccaatcctgcgtcagcagaaaagggaacaaaacaaccgcaggctcgctttgtcctgtcagcgcccgcccgtttcgatctaaaaaagagcctcttccatctgaaatgagcacttcctccgtccgctgtttcacgctttcttgaatcaaattaattttctttttagaaaatgattctgtgaaaaacagctggatttctgcaagcctcagcagaagcagaaaaaatacaatcaaaaatgcgatgactgccagcttcattcgtttcgatatcttcataaaaaaacacctcacccacattgtggacgaggtgtttcgctgctaaacaaatattatgaaattttcacaattttcacgagcatttctccgcccggtgtttgtactgtgacttcttcatctacttttttgcccaagaggctttttgcgatcggtgagtcgtttgagattttcccttcaaacgggtcagcttccgcgcttccgacgatcgtatatgattcttcatcaccgtcaggcagttcgacgaaagtgacggttttacccaaaccgacaacgttagagccgccgtcatcttcaatgattttcgcattgcgaatcatattttcaagagtcgtcacgcggccctctacaaatgcctgctcttctttcgctgaatcgtattcagagttctcggaaaggtctccgaagcttctcgcaattttgattcgctctactacttcttttcgtttaaccgttttcaaatattctaattcttgttcaagtttttgttttccttctgcagtcataggaaatactttctcttgtgccatgtcccttcactccttctggttgtccctcaacatcttcgattatgtatgagagcataaactaaaaaatacaagaatgagaacacagggcagtcctcgttcttctctcccatataggtactgtttatcttaaactgaatcgtgtcgttctgcaaatatttcgcgtttataaacagggaaagaagggaattcgcacattcccttcctgcctatacataatatggtcagagttatttatgtctatgctatggtattacaaaatcgcgttttgttctagtatcgtctgaatttttgtgaccatcagatcaattgcgacgtgattctgaccgccttccgggataataatatcagcgtatcgtttcgtcggctcgacgaattggttatgcatcggacggaccactgacacatattgttcaatgacagaatcaatagagcgtccgcgctcattaatatctctcataatccgtctgatgatacgcaagtcagcgtccgtatcaacataaagcttgatatccatcagatcacgaagccttttgtcttcaagaacaagaatgccttcaaggataataacatcctttggctctacgtgaaccgtttcttctgaacgtgtgtgaagcttatagtcataaatcggcttttcaatcgggcggtaattcaatagatcctgaatatgctcgattaaatagtcattatcaaacgcaagcggatgatcatagtttgtgttcagcctttcttcaaacggaagatggctttggtctttataataaaggtcctgctggatcattaaaattgagtgtcctttaaactgttcataaatggaccgtgtgacactcgtttttcctgaaccggaacctcctgcgattccaatgactactggattcttacccatgggctgttacttcccctttctcatcatgttgctcggataaatctttttgtctagtttgaatttgacaatttgcaggggatggcgggcagcatctagctcatttccgtcttcgtcccaaatggtttcaatcgtatgtgtaaagttttcgatttctggaccgaaaaattccacttcgtcgccttttttgaagaaattgcgctgctgaagcgtgaccatttgtgtatcttcatcataattcagcactaagccgacaaaatcatatgtcgttttcttggcgtgttcgccgaacatttgctcttcatagcctggcgttccttcaaagaaagctgtcgcagtgtccctgttggcgcacttatcaagctcttcaagccattctttttgaatcacaaagttttctggatcagcgcaataagcatcgattactttgcggtatacgctgacaacagttgctacatagtgaatggatttcatgcggccttcaatctttaagctgtcgatccccatttcaatcatttttggaatggattcaatcagcttcaaatctttcgggctcatcgcaaatggtgcatcttcttcaccatacaaagcaacggcgttggcaccgtctgtttgatagagatcataatcccagcggcatgactggcagcagcctccgcgattggagtcccgcgctgtcatgtgattgctcagcacgcagcggccggaatatgcgatacacattgcgccgtgaatgaaggattcgatttcgatatctaccttttctttcatttctctgatttcaagagcgctagtttcacgtgccagcacgacgcggtcgagaccttcttccttccagaactggacagccttccagtttgaaagagactgctgtgtgctcaagtgaacctcaacattcggcgccactctgcggcatgtttcaataataagcggatctgccacaataataccggcaacgttggcgtctccaagcgcttttaaatagtcttcaagcccgtccatgttttcattatgagcgaaaatattcgttgttacgtagatcttcgcgccatatttctttgcgaattcaacgccttctgcaatttcttcgatcgtaaagttatcggcattcgagcgaagcccgtattcctgtcccccgataaagaccgcgtccgctccgtaatgaacagcgattttcagcttttcaagattacccgcaggtgcgagaagctccggctttttcgtaatcacacgctttccattaacgattgtggatattttatcatttacggcagtcatagcttaacctccttttgattaataaaccgtttccttgaagaagaatccggtatcaatttttctgtttactggctggatgctttcaatgtgttcgatccagtcttcttttttcgcttcgtattcgtcacggttttccacgcacaaatcaattgcttctctgtacattttggtgacttctattaggtattcaggcgttttcaaaacaccatcgattttgaaagaatcaattccggcatctatcaattcctcgagctcatcaatgatgcacacatcgttcgggctcatgatgtgagtgccgttttcatcttcgaaaatcggatatttattatcgcgttctttatcgtgtaaaaacatgcctgattcttttttctttctttcaatgtccatgactttgccctgatattcaaaatagtttccaatcaaagaacgcttcgattggaacatgcacgtcattccatgcacctggatttcaatttcgacttcagcattttctttaatctcaacaatgctgtccatgtttaattctctggcaagcacagaacgcgccgcacccttgcgtccccagtagttgcatgtataatagttggtgcctgtcgtttctgtgctccaatgaagcttcagatcaggcgcagattcacgggcagccatcagcacggcaggatcgccgaataccgctgcatcgacaccggcttctgctaagaaagccagatattcgccaagctcacccactttatcgttatggaaaattgcatttacagcaacgtatatttttgccccttctttgtgagcaatctctacggcttttgttacatcttcacgagaaaattctccggctaatctcaagccgtatctctgttccccaactaaaaacgcagttgccccagcctgtatgagcggcaaaatgtccgctgtgctcgtcggcgtcactaagagctctggttttttcatgacgttcacctcttctttttactaatcgcaagtccgtccccgacaggaataatcgcagtttgataatccggatgattcatcagccaatgattatattcatcaatttttgctacaagcctgcgccttctcttcggttctattttgctgtaatcctctgccaccagacccttaaacagcacgttgtctgttataatcaccccgtctggtgaaagcatcggttcatataaatgaaaaaagttttgatactgaccttttgcagcgtcaataaaaatgacatcgtaaggcgcggttacatgaacggcgtcggctaattcaagcgcatctccgtaaaaaacatgaatccggtcatcaagctgaaattccttgatattgtttaccgcttcttcatgccgtttctcattgcgttcaattgtatatatttcagcagacggcagctccagcgccatccgaatggctgaataaccaatggccgttccgatttctagtatttttttcggctgtttcacagacaaaatttgaagcagcacctccatgcccgctttttccataatcgggacatgatgttcttctgcatatgcttcaagcttcttcacgttatccggccgaggctttaataatgcttctatatagtcatttatttgttcataccggtcagtcactacaaacagcctcccgttctaaaaaggagtgccccagtcttatgcgcaggacactctctgaatacatcatgatacatcggtaaacaacccgatatattttatcataaaaccttgcggaaagcgaacaaaaggagagctttttgctctccttttatttctcattttttgaggaaatgtatttttcttttgctttattatgctcttttagcgtttttgtaaatacgacctcaccatttgatttggccaagaaatacagatagtccgttttatccggatgcagcgccgcttcccatgacgacataccggcattggcaatcggccctggcgtcagccctgtgtttttatacgtattgtatggtgaatcgatttccagatccttataaagaacccgatctttatgcttgcctgccgcgtacaggacggtcggatctgtttggagcggcattttctttttcaggcggttataaaagacgctcgcaattttatggcggtcggctttttcagtcgcttcttcttctatcaaagaagccattgtcagcagcttatgcacagaaactttgtttttcttcatttctgatttatatgtttccacataagaatttgtctgcttaatcattgccttgataatgtcttcaagtgatgtgtccgggtcgttaaaagggtatgtagccgggaataggtacccttcaagcgggtgcttaatgtttttattgaaaacatcatttgtcacagtgtccgggaattctttcttcagctgattgataaatgtttcatcgtccagcttcgctatgacttgttttttagagtattttgtttcatcagcaatagcagccgcgatttgggtcagctgtgctccctcagtcactgtgatttgaaaagcgtaacctgcagccccgcttgtcagcttctgaataatggcatctaaatccatacttttattcagatggtagaatccggcctgaaacccggaagcacctttatatttcacatagtactgaaacgccttctcgctttttatgacatcatttttctttaatatcgatgcgatggctgaaacagacgaaccgctcggaatgttaatattaactgtcgttttactgtctttttcaacaggttcaagcaatgatttcccatataaaaatgccccgccaatgatgagaaacagcacaacaatggaagacagtatgattctttttttattaaaaaacgattttttttgctgattgatatacattaggtctcctcccatcagctcttatactacatgattcattgtatttcggcaatttattacaaaaagaggcctgcataaagcagaaaaaagccggagcagtatagctccggctttggtttggcgcgatgttttactcttcgtcttcgtccgctaagaatgtgtttaatgtttcttcgatcatatcccattcttcgtcagtttcaatcgggaatagctcaccgttttcaccgtcttcgtttggcgtgaagctggaagcaagaatttctacttcttcgtcatcttttgattcgattggatagtacaagacataagacttgccaaactcttcgttttcaaatgtaaacagcacttcacaaagctgttcatttccttgatcgtcaacaattgtaatatttttttcgccgtgttccattttcttcacctctggctttaatttaagctgtcaagatatccttgtaaaatcataacagccgccattttatcaatgactttttttcgtttttgcctgctgacgtcagctgcaatcagcattttttcagccgccattgtggtaagacgctcgtcccacagcacaacaggaacattgtacgttgtttcaagcactttcgcaaatgtttggctggcttcgcctctcgggccgactgttccgttcatgttcttaggaaagccgagcacgattttatctatagtatagtcctttatcagttcagataaacgggataaaccataatcgccttctgcttcatttatctttatggtctcaatgccttgagcagtccagcccatttcatcgctcagagctacaccgagtgttttggttcctaaatcgagtcctaatattctcattctttatttacgcctctttatgctgttctaaataagactttaccaattcctcgattaattcgtctctttcaagtttgcgaattaaattgcgagcgtcacgatgcctaggaatataagcgggatcacctgacagcaagtatccgacaatctggttgattggattgtagcccttttcctgaagcgcgtcatacactgtaatcagcacctcatttacgttagtctcagcagaatcatcggagaaattaaatttcatcgttttatcaaacgagctcaccgttttgcacctctttcccaaattcgcaggcaaagttcagcctggggtcctaatcttaccatcattctacactacatgggcgaattataaaacggatttcacccaatcttctacagaagccaaagcttcttctaatttttccggctgtttacctcctgcctgcgccatgtccggacggcctccgccgcctccgccgcaaacttccgcagcttgtttaaccagcttgccggcgtgaaggcctttctcaatgaggtcctttgtgactccggcggagatattaactttatcgttttgtaccgcaccaagcacgatcaccgcagagccaagctttgctttgagttcatcgaccatagtgcggagatgattcatgtcttttgcatttacttttgccgcaagcacgtttacgccgtcaacttcttttactttcgacaggattgctcctgcttccacgttgcctagttttgcaagaagagattcattttctctttgtgcatccttcagttcagcctgcagagccgcgacccgtttcggcacttctttgatatttgttttcagctcgtcagcggtctgcttcaatacagaaatctggctgttcatttcgacgtaagcgccttgtcccgttacagcttcaatccgtcttgtgcctgctccgattccggattcagaaacgattttaaacaagccgatttctgctgtatttctgacatggcagccgccgcacagctctaagctgtaatctccaacttgaacgacacggacaatatcgccatatttctcgccgaacagtgccatcgcacccatttcttttgcttcagcgatcggtttcaaatcaatgctgaccgggatgctcgcccagatcttttcgtttacgattctttcaatttgttcgagctcttcttttgtcacttggccaaagtgcgagaagtcaaaacgaagacggttttccgttacaagagagcccgcctgattgacatgagttccaagaacatcttttagagcctgatgcaataaatgcgttgccgtgtggtttttaatgacgccgcttctcatatggtcttcaacttcagccgtaacatgcaggcctttttgaacagtaccgctctctacaacaccttcatgcacatgctggccgttcggcgctttttgaacatctttaattcttacaacggcctgctcgtttcggagatagcctttatcgccgatttggccgccgctttctgcatagaacggtgtttcatcaaggatgatttgaacgctttctccttcatgagcctcttcgattaattggccgtcctgaagaagcacaatgatattggcatcagctttggtttgagagtagccgacaaatgtgctttcatctgtcacgtcgcgcagtgcgccgccctgcacctgcatgctgccgacatcctggcgggcgtttcttgcccgttcacgctgctggttcatttcctcctcaaagccctcatggtcaaccgtcatgttctcgtcttctgcgtattcttcagtcaattcaaccgggaatccatacgtatcatacagtttaaacacatcagcacctgagataacgctgctgcccttgtctttttcttttttgatcatttctgacaggatcgcaagcccttcattaagggtctcatggaagcgttcttcctcggttttaatgacttttgcgatgaaatccgctttctctttcacttcaggatagaaatcagccatgatttctgcgacaaccggcactaaatcaaacatgaacggacgatggatgttgatcgttttggcataacgcacggcacggcgtaataagcgtcttaatacatagccgcggccttcatttgacggcagcgcaccgtcactgacagcaaaggcaaccgttctgatatggtcagcaatcactttaaacgcagtgtctttcacattgtctttgccatatgtttcaccagaaatcgattctgttgctttaatgatcggaacaaacaaatcggtgtcaaagtttgtcggaacattctggatgacagataccattctttcaagacccatgcctgtatcaatgtttttctttggaagcggtgtgtacgtgccgtcagggttatggttgaactctgagaacacaaggttccatacttccaggtaacggtcgttttccccgcctgggtaaagctccggatcttctggatcattaccgtatgcttcaccgcggtcgtaaaagatttccgtattcggtccgctcggcccttcaccgatatcccagaagttcccttccagacggataattctttcttcaggaataccgatttttttcgcccaaaactcatatgcctcttcatcttcaggatgaaccgtaacagagagaagctctttgtcgaagccaatccacttgtcgctcgttaaaaactcccaagcccatgtaatggcttcttctttgaaataatcgccgatggaaaagtttccgagcatttcaaagaaagtgtgatggcgcgcagttttacctacattttctatatcgtttgttctgatcgctttttgagcgtttacgattcttggattttccggcacgacacggccgtcaaaatattttttcagcgtcgcaacaccgctgttgatccaaagcagtgaaggatcctcatgaggcactaatgacgcgcttggctctaccgcatgtcctttttctttaaagaaatccaaaaacatttgacgcacttccgcagaagttaagtgtttcattgtatttcctcctctataaaaatcgaaattctcttcagtgacagcaaaaaagccctcccccctatgcaaaccaacgtttacacagggacgagagctgtctcgcggtaccaccctgattacgggcattcattcgcccgtcacctttaaccctgtaacgcaggataagcggcagtgattaactgcactcaggattagcttcctccgatcttctgataaagctcctttcagcttatggagcttctctctttaacagggcttcggcgtactcagatccgtcactcgagattcgtatgtattctacgagaaattatagacaagcggcacgccgatgtcaatgctccgtcctcatccgcaaaaaatggatcatcattacttttaaaacagccgtcgcaggaacagccagaatcatcccgacgattcccgcaagctcccctccggcaaggagtgcaagcatgataacgaccggatgcattttaaggcttctgccgacaatgaacggactgaggatatttccttccataaactgcagaataaacaccgtaatcaccacaacaagaaccgccttgactgagatcgtcatcgcaattaacaacgcaggaacagctccgatgaaagggccaaaatacgggatgacattcgttactccagagataaggccaagtatcagcggatatggaagcccaaatacccagaacgaaatgcctgcaatcacgccaagaatcaagcagaccaaaagctggccgcggatataatcgccaagcgaatcatccacatcccgcaaaaaggcgctgccccgctttctccacgacttcggagtcaagtaccatactgtctttttcattaactcaatgtccttcaccatataaaacacgagaaaagggattgttgcagcaattaagaagtaatcaagcacattgcggatcccgctgatcgcaccctcgatcgttcccgcaaaaaacgcctccgtctggcggatcattttatctatacggtgatgcataccatcaggccagtcatccgtatggttatgcacatgaagaagaagcccgttatacgtttcggcaaacatgggtatattttctgacagatccgtcagctgcacgattaaaacaggcacccctttatacaacgcccagccaatcccgccaaaaaaaagaacataaatgaccaagatgctcaaagtcctaggcaatcctttgccatgcagccattctgtgaccggaagcaataaataagatataaaaatagaaatgatcaagggaataaagatcgtttttatgacgagccaaaagggtgaccataacatatcaagcataaaaaagacatagactgttaacagaaccagcaaacaaatagccacccacaacaaaagctgcaccggtttttggagcatctgctttcacctcacctatatcttttgaggtttacaaggaattattctttatgtttctttagtcagtcagaagtcatggacattttttcacttttaattttcagaaaagtttgatcatttactttttggtcaaattttctgataggaggattgcgatgatcacatttcaaaatgtaaacaagcattacggagattttcacgtgttaaaacaaattaatcttcaaatcgaaaaaggtgaagtcgttgttatcatcggcccatccggttccggtaaaagcacattgctcagatgcatcaacagacttgagtcgatcaatgagggagtgcttacagtaaacggcaccgccattaacgacagaaaaactgatatcaatcaagtgcggcaaaatatcgggatggtgtttcagcactttcatttatatccgcataaaacagtgctgcagaacatcatgctggctccggtaaaagtgcttagacaatcacctgaacaagcaaaggaaacggcgcggtactatcttgaaaaagtcggcatcccagacaaggctgacgcctatccttcccagctttccggcgggcagcagcagcgtgttgccatcgcaagaggactggcgatgaagccggaggtcatgctgtttgacgagccgacatcagcacttgatcctgaaatgatcggtgaggtgctagatgtcatgaaaacactcgccaaagaaggcatgacaatggttgtcgtgacacacgaaatggggtttgccaaagaagttgccgaccggattgtcttcattgacgaaggaaaaattttagaagaagcagtgccggctgaattttacgcgaacccgaaggaagaacgggcccgcttattcttaagccgtattttaaatcattaaaacagaaatgggggagcttgtatgaaaaagattttttctttagcattgatttctttattcgctgtcatcttgcttgccgcttgcggcagcaagggatcaaacggagaagcctcaaaggagagcaaaaaagatacgctagccgccattaaagacaatgacaaaattgtcttcggcgtaaaaacggacactcgactgttcggtcttaaaaatccaagctcaggtgagattgagggttttgatattgatattgctaaacaaatcgctaaagacattttaggtgatgagaaaaaagctcaatttaaagaggtcacctcaaaaacaaggattcctatgctgcaaaacggggatatcgacgccattgtcgccacaatgacgatcactgaagaacgaaaaaaggaagttgacttttctgatgtctatttcgaggccgggcaatcgcttctcgtgaaaaaaggcagcaaaatcaagagtgtcgagaatcttggcaaaggctcaaaagttcttgcagtaaaaggctccacctcctctcaaaacattcgtgaaaaggcgcctgaagcatctgttttagaatttgaaaactacgcagaagcctttacagcccttaaatcggggcaaggcgatgccctcaccacagataatgcgattttatatggaatggctgatgaaaataaaaattatcaattaacaggaaagccttttacagatgagccttacgggatcgccgtgaaaaaagggcaatctgctctcgcgaaagaaatcaacgcttcacttaaaaagatgaagtcggatggcagatacgatgaaatttataaaaaatggatcaaagaagacccagctgaataacaaccatcccgggatgagcaggcgatgctcatcccaatttgataaggagtgaataggcagatgaatgtgtcaattcttttcgataacttcggcatgtatatggacggtttttaccataccttgctcgcaagtgttatcgcgctggccggcagttttgtcctcggcgttgctgtagcggttatgagaataacagtctttaagccgctgcaatggctcgggaccgcatatgtagaattcatccgcaacatccctcttcttttaattacctttgttttctatttcggacttccaaacgcaggcctgaggcttgacggttttcaagcgggaacggttgctctcaccatttatacctctgcgtttatcgctgaagccatcagagcaggcatccagtctgtttcaaaagggcagatggaagcggcacgctcgtcaggctttacctacagccaagccatgctccatatcattttgccgcaggcaatcaaaatcgtcattccgcctttaggcaatcaatttttaaacttagtcaaaaactcttcgattcttggggttgtggccggattggatcttatgtaccaagccgatttagtttcgtcgagcacactcgttgtatttgatgtttatatttttgtggcgcttttttacttagtgctgacgattccgcttagcatcggtgttaactatctggaaaaacggctggaaaaaagctattgataaggagtgagttacattggatttcatcggtgcttattcacaggagcatttagcgtttttatgggatggctttctcgtcaccttgtacgttgctttcatctccatcattctgagctttttcttcggtttaatcgcaggaaccctgcgttatgcgaaagttcccgttctttctcaattgattgcggttctcgttgaaacgatcagaaacctccccttgctgttaattattttctttacgttttttgcccttccggaaattgggattaagcttgaaattacagctgctgcaattacagcactaacgatttttgaatccgctatgctatctgaaattatccgaagcggactgaaatcaattgacaaaggacaaattgaagcggcgcgctcctccgggctgagctatacacagaccctgttctttatcgttatgccgcaagcgcttcgccgcatggttccgcccatcgtaagccagtttatttctttattaaaagatacatcgctcgctgttgtgatcgccctgcctgaactgattcacaacgcgcaaattattaacggccaaagcgcagacggcagttattttttcccgatctttttacttgcggcccttatgtatttcgcagtcaactacagcctttcactcgcagcaagacgcctcgaggtccggcaaacatagaaaaggatactctttggagagtatcctttttgcattaaaacattttcgtaattcttcttctcatccgcttcatgcttcgattattcagcatgtcagattgagtcgccattcggtacacgagagctccggctcccattgccaaaagagaagtcatcgtccgattcatcctgcgcatctcctttcatgattaaaaattgatgctgcgttcatcctcagaaaacaaatcatccaagctgcttaacgttccgtcttcttccacctgatgagttgcaatcttccctttcgccactgtcagttcaataaaacagccccaacaataatattggttcacgccgattttgccgatatccttacttttgcaattcgggcatataagcatacctcacacctctatccgttcagaacgatctcgtctttccgcacctcgacaagcgaatccgctctttggatctggcgcttgcttcccgccaggtcagaaaagaaaccgtccgagagttcatatgctacgattatgcccctgtccaaacaaaagtatacatcttccagcatccccaatatatcgccctcttgcgatttcacaagcttcatcttcatctgctcgtatgtgaagcatgatttcggaagaggcaaaagctgttctgaactgaccgaagccaatatgcggtcatcaagaatggaagagatatcacacgcccgtaatagcgtatgatgatgatgcaaaaagcgtttttgtgcaagaataaacccaagacaatctcctttcagagaaaaacaaatatcggaaattgtcccaagataactagaagttcgttctgagtatactgggaatccttctacttcatggcatgttctcaaagtgtgatcaaccaccttttgttgaacaggcttaggttttgctttgcgccttagactcatacgatgaaatcaattccactgcaaatgaaaaaactcccgcttacacgggagcattttattgctgttcttctttcataaaatcgaatggtgtaatgccttccatgccaatgttggcgtcgtgtacgctgaacgggagctctttttggagagcctcaagctcggcatccatttcctcaacctgtacggacagcctgtttttcaaggaggtctgtctgacagttgcatcattattttttacgccccactccagcgcctcctcctcaccgcataaaatgagaaatttcttcgctcttgtaatcgcggtataaagaaggtttcttctgagcattctataatagcctttcacaacaggcaaaaccacaatcggaaattcacttccctgcgatttatgaatagaacagcaatacgcatgggtaaattgattaaaatcttttttcgtaaacgtcatttcattgccatcaaaagaaacaacggccatgtcttctttttctgtattttcctttgcataaaatatcgacgtgatttcgccaatatctccgttgaatacattgttttccggctgattgacaagctgcaaaattttatctccggttctgtagacaacatccccgaacttcaattctctccgtttttctttaggaggatttaaaatgtcctgcagcatcacattcaattcattaatgccggcttttcctctgtacatcggagcgaggacctgaatgtcctttgctgtatagccttttttcaatgcattggcgacaaccttctcaactacttctttgatttgcgacccgccgcagcgaataaaggaacggtcctttgtcggggcagtcaaattgttcggcagcaatccatttttcatctggtgggcaagctcgacgattgatgacccctccgcctgacgatagatgtctgtcagtctcacagtcggaatcacctgggatgccagcaagtctctgagcacttgtcccggaccgacggaaggcagctggtcttcgtctccgacaatgatgatttgtatatgatcagggatcgccttgaacaaatgattcgccagccatatatcaagcatactggcttcatcgataattaacagcttcccttcgatcggctgatcctctgtatgagtaaagccttcagcaccgttccagccaagcagcctgtgtatcgtgactgcagggagtcccgttgattcactcatccgttttgctgctctccctgtcggagcggccaaaacaatcggaaaagcttcatcctttttataagctgacggatctagtgacacaccgtgaagctctccgtagagctcgacaatccctctgattaccgtcgtttttcctgttcccgggccgcctgttaaaagaagcatcggcgaggaaagggctttttgaatcgcttccttctggctgggggcatactgaacattcatccgttcttccagttctcccaacgcgagcaaaaactctgattcgggaaactggttctcatattcggtttggctagcgatatgtttcacacgctttgcaacgttttgttctgcgtaaaacagcgaaggaaaataacagcggccatcttctatgacaatgtctttattttctccaagggcaataatcgcgttagcggcatccatttctgtgatgcgctgcccttcccttgctgactggtttaacagtgattgagtgtcgatgatcagctgttccgtttctatgtacgtgtgcccctctgacagacaagtcgtttcaagcgtgtacaaaatagcagcttttacccgctcaggatggttacccgaaagacccattctgctgcccagctcatccgctttcccaaacccgatgccttctacatccttcacaagctgataaggattttcctgaatcttttcaagcgtctcggattcataggcttgatagattttcatagacagctgcgggccaaagccaaactgattcaaggaaatcatgatttgctccagtccctgatgccgctgcaatgcgccagccagcgtgtcggctttcttttttgagagtctgggaacatcataaagcactgaagcatcagccaatattttattaatggcgctgtcgcccagctttttcacaatttcttcagctgtttttttgccgatcccctcgaataaatcactcgataaatattgaatgatgccttccttagtcgttggaatctcctttttgaaatgctccgcctgaaattggagcccgaactttggatgggttacgatctttccgtaaaacgtgtaggtctcttcttcttgaagcgcagggaagtagcccgtcacggatacggctttatcttcaatggcttcggaggtctctgtgactttcactttcagaaccgtatataaattggtgtcattatgatagatgactgtgttgactgtcccttttaaatagggctcttcctccagtttaagctgatccggatgctgctgcacgagctgtccctcctcctgtgcctgttatgatggatcaatcagttttttagcatgaagcgcaagcatatgatctggctggatatcaattgccttgtccagcatttccagcgctttttctcggttttctttataagcataagcgacaccggcattataaaatgcatctgcatgccccgggtcttgctctgttacagctgcgaattggctgagcgcttcgtccagcatgccctcgttggctaagcacatcccgaattgaaaacgtgcttccgtatcgttttcattcagttcgaccgctctttgtaaatatggcagtgcaagcttaggctgttcgagcttgacaagtaccgttccgagcatgtaaaacaggtcgccgttttccatccccgcacgtagcgctttttcaaacatgtctttcgcttctttgtacatttcttttacaacatagacatttcctgctccataataagcagtggctgcgctactgtctaattcaagcgctttatcataaaacgcaagcgcacgttccagctcgtttacggatgaaagaaggttggcaaaattgatatacggaatcgcgtcttctttattttcttcaatcgcttttgtaaatgcctctgccgctttctcgtaatcgccttcctgcatcgcctctataccgagttgattataatccaccgatcatcttcctttcattaaaaaaccccaactcagtgttgaggtttttcatcttttatacgtaccacaattttgttccgtctttgtacacatcatcaattgtcccgccgccaaggcattcttcgccgtcatagaagacaacggcttgtcctggcgttacagcgcggacttgttcatcaaagatgacttccgcttcaccctcgccagtcatgcgcaccgttactttatgatcttcttggcggtaacggaatttagccgtgcaggaaatctcttcgccctttatgatatccgaacgtacccagctgatatttgttgctgtgattttgtcggaatataaaagcgggttatggaacccttgatccacgtagaggatgttcttttcaagatctttgcctaccgcaaaccacggctcgccgcttccgccgatgccaaggccgtgacgctgtccgatcgtatagtacatcaacccgtcgtggcggccttttacttcgccgtccatcgtcatcatatcgcccggctgtgcagggagatattggctgagaaacgttttgaagttgcgttcgccgataaagcagatgcctgtactgtcttttttcgtcgccgttgcaagttctgcttctttggcgatttcacgcacacggcttttttgaagttcgccgatcgggaacatgactttgctcagcgtatcttctgtcagctgattcaggaagtacgtttgatccttgttttcatcaatgccgcgcagcattctgacttttccgccgcttctgtctactcttgcatagtggccagtcgctaaatagtcggcgccaagtgacaatgcatgctccaaaaaggctttgaatttaatttctttgttgcacaatacatccgggtttggtgttctgcctgctttatattcatcaaggaagtattgaaataccttctcataatattgcttttcaaagtttacggcataatacggaattccgatttggttgcagacgcggatcacatcttcataatcctctgtcgccgtgcaaaaaccgttttcgtccgtatcatc
